US012661367B2

(12) United States Patent
Huang et al.

(10) Patent No.: US 12,661,367 B2
(45) Date of Patent: Jun. 23, 2026

(54) ***STREPTOMYCES SPORORAVEUS* STRAIN AND A NEW ANTIBIOTICS AGAINST BACTERIA AND FUNGI**

(71) Applicant: National Taipei University of Technology, Taipei (TW)

(72) Inventors: Chih-Hung Huang, Taipei (TW); Pu-Chieh Chang, Taipei (TW)

(73) Assignee: NATIONAL TAIPEI UNIVERSITY OF TECHNOLOGY, Taipei (TW)

( * ) Notice: Subject to any disclaimer, the term of this patent is extended or adjusted under 35 U.S.C. 154(b) by 532 days.

(21) Appl. No.: 18/319,312

(22) Filed: May 17, 2023

(65) Prior Publication Data

US 2023/0405036 A1    Dec. 21, 2023

Related U.S. Application Data

(60) Provisional application No. 63/343,298, filed on May 18, 2022.

(51) Int. Cl.
| | |
|---|---|
| *A61K 39/02* | (2006.01) |
| *A61K 31/7048* | (2006.01) |
| *A61P 31/04* | (2006.01) |
| *C12N 1/205* | (2026.01) |
| *C12R 1/465* | (2006.01) |

(52) U.S. Cl.
CPC .......... *A61K 31/7048* (2013.01); *A61P 31/04* (2018.01); *C12N 1/205* (2021.05); *C12R 2001/465* (2021.05)

(58) Field of Classification Search
CPC combination set(s) only.
See application file for complete search history.

(56) References Cited

PUBLICATIONS

Al-Askar et al (African Journal of Agricultural Research vol. 6(12), pp. 2835-2842, Jun. 18, 2011).*
Chang et al (Antibiotics. May 18, 2022. 11(5): 679, pp. 1-10).*

* cited by examiner

*Primary Examiner* — Jennifer E Graser
(74) *Attorney, Agent, or Firm* — Birch, Stewart, Kolasch & Birch, LLP

(57) ABSTRACT

Disclosed herein is a UV mutagenesis produced new *Streptomyces spororaveus* strain SC263 that exhibits an increased thermostability of the antibiotic produced, which shows antibiotic activity against bacteria and fungi. Also provided are the antibiotic produced by SC263 and a composition thereof for treatment of bacterial and fungal infections. The antibiotic has a very high molecular weight, which is suitable for topical administration.

19 Claims, 5 Drawing Sheets
Specification includes a Sequence Listing.

(A)                   (B)

(A)                   (B)

STREPTOMYCES SPORORAVEUS STRAIN AND A NEW ANTIBIOTICS AGAINST BACTERIA AND FUNGI

CROSS REFERENCE

This Non-provisional application claims the priority under 35 U.S.C. § 119(e) on US Patent Provisional Application No. 63/343,298 filed on May 18, 2022, the entire contents of which are hereby incorporated by reference.

REFERENCE TO AN ELECTRONIC SEQUENCE LISTING

The application contains a Sequence Listing which has been submitted electronically in .XML format and is hereby incorporated by reference in its entirety. Said .XML copy, created on May 15, 2023, is named "HJH0002US-Sequence-Listing.xml" and is 8,221,249 bytes in size. The sequence listing contained in this .XML file is part of the specification and is hereby incorporated by reference herein in its entirety.

FIELD OF THE INVENTION

The present invention provides a new *Streptomyces spororaveus* strain SC263 and antibiotics produced by the strain SC263. The present invention also provides a composition containing the antibiotics against bacteria and fungi.

BACKGROUND OF THE INVENTION

Development of antimicrobial resistance in pathogenic bacteria and fungi has led to global health emergencies [1]. Annual death resulting from diseases caused by drug-resistant pathogens is estimated to be over 700,000 in more than 120 countries according to World Health Organization [2]. The urge for new antibiotics or antifungal compounds from natural products is eminent.

Patients with immunosuppression are prone to be infected with multi-drug resistance *Candida* [3] and *Aspergillus* [4]. Nearly all Clinical antifungal drugs exhibit a molecular weight lower than 2000 Da [5]. These commonly used drugs for antifungal infections including amphotericin B (used for intravenous injections), flucytosine (used for oral and intravenous injections), and itraconazole (used for oral and intravenous injections) may exhibit severe side effects such as nephrotoxicity, hepatoxicity, bone marrow suppression, and heart failure, limiting the use of these drugs [6-8]. Drug with less toxicity such as natamycin produced from *Streptomyces* species is considered relatively safe and for topical application such as eyedrops but is nearly insoluble in water with low bioavailability when orally used [9].

*Streptomyces* species, which are ubiquitous in fertile soil, are the major producers of natural products. They produce nearly 8,000 natural products, accounting for approximately 45% of all from the microbial sources [10]. About ⅔ of clinically useful antibiotics are produced by *Streptomyces* [11], including many important drugs, such as streptomycin, neomycin, kanamycin, rapamycin, chloramphenicol, vancomycin, etc. [12]. This genus is predicted to possess a repertoire of approximately 100,000 antibiotics, of which only 3% has been discovered [13]. For decades *Streptomyces* have been continuously explored for novel and useful antibiotics [14,15].

It is desirable to develop a new strain which can produce antibiotics with enhanced antibiotic efficacy.

BRIEF SUMMARY OF THE INVENTION

Disclosed herein is a new *Streptomyces spororaveus* strain SC263 that exhibited increased thermostability of the antibiotic peptide as produced.

The present invention also provides the antibiotic produced therefrom, named AF1, which shows antibiotic activity against at least six fungi and two Gram-positive bacteria, and exhibits an apparent molecular weight larger than 5 kDa, particularly larger than 100 kDa, which is unusual in antibiotics. Also disclosed herein is the use of AF1, especially for manufacturing an antifungal composition.

In one aspect, the present invention provides a new *Streptomyces spororaveus* strain SC263 producing antibiotics with increased thermostability.

In the present invention, the *Streptomyces spororaveus* strain SC263 was deposited on May 30, 2022 at Leibniz-Institut, Deutsche Sammlung von Mikroorganismen und Zellkulturen GmbH (DSMZ) in Germany, at Inhoffenstr. 7B, D-38124 Braunschweig, Germany, which is an International Depositary Authority (IDA) under Budapest Treaty in World Intellectual Property Organization. The accession number is DSM 34277.

In one embodiment of the present invention, the strain SC263 has the DNA sequence set forth in SEQ ID NO.: 1

In another embodiment of the present invention, the strain SC263 has the DNA sequence set forth in SEQ ID NO.: 2.

In one further embodiment of the present invention, the strain SC263 has the DNA sequence set forth in SEQ ID NO.: 3.

In one further aspect, the present invention provides a composition comprising the strain SC263.

In one yet aspect, the present invention provides an antibiotic AF1, which is produced by the strain SC263, and exhibits an apparent molecular weight of larger than 5 kDa, particularly larger than 100 kDa, measured by membrane-filtration concentration.

In one embodiment of the present invention, the composition comprises an antibiotic exhibiting an apparent molecular weight of larger than 100 kDa, and an antibiotic exhibiting an apparent molecular weight of 10 kDa to 100 kDa, measured by membrane-filtration concentration.

In one embodiment of the invention, the antibiotic AF1 is effective against fungi.

In one embodiment of the invention, the antibiotic AF1 is effective against Gram-positive bacteria.

In yet another aspect, the present invention provides an antimicrobial composition comprising the antibiotic produced by *Streptomyces spororaveus* strain SC263, and a pharmaceutically acceptable carrier.

In one embodiment of the invention, the composition is for treatment of a fungal infection.

In one embodiment of the invention, the composition is for treatment of a bacterial infection, particularly a Gram-positive bacterial infection.

In one embodiment of the invention, the composition is administered topically.

It is to be understood that both the foregoing general description and the following detailed description are exemplary and explanatory only and are not restrictive of the invention.

BRIEF DESCRIPTION OF THE SEVERAL VIEWS OF THE DRAWINGS

The foregoing summary, as well as the following detailed description of the invention, will be better understood when read in conjunction with the appended drawings. For the purpose of illustrating the invention, there are shown in the drawings embodiments which are presently preferred.

In the drawings.

DETAILED DESCRIPTION OF THE INVENTION

Figure 1:
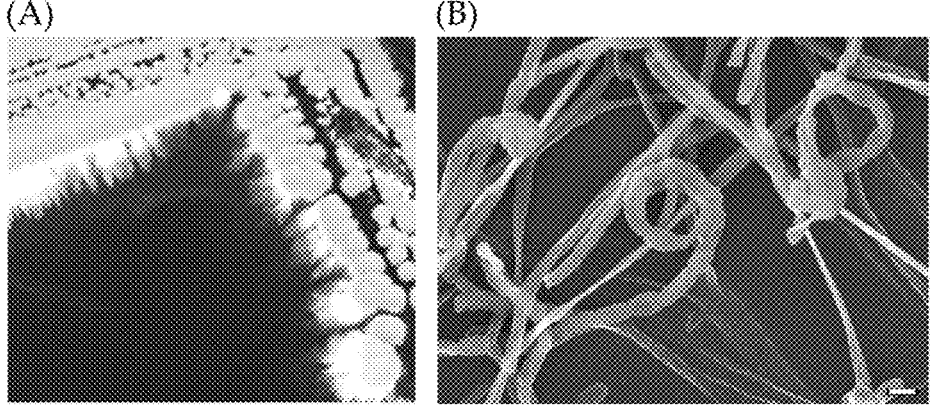
FIG. 1 shows the morphology of SC26: (A) Colony morphology of SC26 on YM1 agar after incubation at 30° C. for 6 days. (B) Spore chains of SC26 under field-emission scanning electron microscope (FE-SEM). The bar indicates 1 μm.

The above summary of the present invention will be further described with reference to the embodiments of the following examples. However, it should not be understood that the content of the present invention is only limited to the following embodiments, and all the inventions based on the above-mentioned contents of the present invention belong to the scope of the present invention.

Unless defined otherwise, all technical and scientific terms used herein have the same meaning as commonly understood by a person skilled in the art to which this invention belongs.

As used herein, the singular forms "a", "an", and "the" include plural referents unless the context clearly dictates otherwise. Thus, for example, reference to "a sample" includes a plurality of such samples and equivalents thereof known to those skilled in the art.

The term "composition" as used herein, refers a product that results from the mixing or combining of more than one active ingredient and includes both fixed and non-fixed combinations of the active ingredients. The term "fixed combination" means that the active ingredients and a certain co-agent are both administered to a patient simultaneously in the form of a single entity or dosage. The term "non-fixed combination" means that the active ingredients and a certain co-agent are administered to a patient as separate entities either simultaneously, concurrently or sequentially with no specific intervening time limits, wherein such administration provides effective levels of the two agents in the body of the patient. The latter also applies to cocktail therapy, e.g., the administration of three or more active ingredients.

The term "composition" or "pharmaceutical composition" used herein refers to a therapeutically effective amount of the antibiotic produced by SC263 and optionally a pharmaceutically acceptable carrier.

The term "pharmaceutically acceptable" used herein refers to the situation in which within the scope of reasonable medical judgment, a drug is suitable for use in contact with a tissue of a subject (such as a human) taking the drug, without excessive toxicity, irritation, allergic reaction, or other problems or complications, and with reasonable benefit/risk ratio. Each carrier must be compatible with other ingredients in order to be "acceptable".

The term "carrier" used herein refers to a non-toxic compound or agent that has the function of assisting cells or tissues to absorb active ingredient. The carrier is selected from, for example, excipients, adjuvants, diluents, fillers, or bulking agents, granulating agents, coating agents, release control agents, binding agents, disintegrants, lubricants, preservatives, surfactants, antioxidants, buffers, suspending agents, thickeners, stabilizers, or other carriers used in pharmaceutical compositions. Examples of carriers include, but are not limited to, polyvinyl alcohol, povidone, hydroxy-propyl methyl cellulose, poloxamers, hydroxyethyl cellulose cyclodextrin, carboxymethylcellulose (CMC), phosphate buffered saline (PBS), water, emulsifier (such as oil and water emulsifier), or wetting agent. Tonicity adjustors may be added as needed or convenient. They include, but are not limited to, salts, particularly sodium chloride, potassium chloride, mannitol and glycerin, or any other suitable tonicity adjustor. Various buffers and means for adjusting pH may be used so long as the resulting preparation is acceptable.

<table>
</table>

5

Accordingly, buffers include acetate buffers, citrate buffers, phosphate buffers and borate buffers. Acids or bases may be used to adjust the pH of these formulations as needed. Similarly, an acceptable antioxidant for use in the present disclosure includes, but is not limited to, sodium metabisulfite, sodium thiosulfate, acetylcysteine, butylated hydroxyanisole and butylated hydroxytoluene. Other excipient components which may be included in the preparations are chelating agents. The preferred chelating agent is edetate disodium, although other chelating agents may also be used in place of or in conjunction with it.

The terms "effective amount" or "therapeutically effective amount," as used herein, refer to a sufficient amount of an agent or a compound being administered which will relieve to some extent one or more of the symptoms of the disease or condition being treated. The result can be reduction and/or alleviation of the signs, symptoms, or causes of a disease, or any other desired alteration of a biological system. For example, an "effective amount" for therapeutic uses is the amount of the composition comprising a peptide or protein as disclosed herein required to provide a clinically significant decrease in disease symptoms. An appropriate "effective" amount in any individual case may be determined using techniques, such as a dose escalation study.

The terms "treat," "treating" or "treatment," as used herein, include alleviating, abating or ameliorating at least one symptom of a disease or condition, preventing additional symptoms, inhibiting the disease or condition, e.g., arresting the development of the disease or condition, relieving the disease or condition, causing regression of the disease or condition, relieving a condition caused by the disease or condition, or stopping the symptoms of the disease or condition either prophylactically and/or therapeutically.

In the invention, *Streptomyces* strain SC26 was obtained by an isolation from the mountain region in northern Taiwan, and then a late-sporulating mutant was obtained from the culture of the strain SC26, which was named as SC263. It was unexpectedly found that the strain SC263 can produce an antibiotic exhibiting much higher thermostability than the antibiotic produced by the strain SC26. The genomic sequence of SC263 was determined, which was classified to a known species *Streptomyces spororaveus* by a pairwise comparison between SC263 and *S. spororaveus* NBRC15456. According to sequencing results, the genome of SC263 contains the DNA sequence of SEQ ID NO: 1, the DNA sequence of SEQ NO: 2, or the DNA sequence of SEQ ID NO: 3.

The present invention provides a new *Streptomyces spororaveus* strain SC263 producing antibiotic with increased thermostability.

The present invention also provides a composition comprising the strain SC263 or the antibiotic produced by the strain SC263. In the composition, the strain SC263 is viable or inactivated.

According to the invention, the antibiotic produced by the strain SC263 exhibits an apparent molecular weight of larger than 100 kDa by membrane-filtration concentration.

In one example, the antibiotic is used for preparing an antimicrobial composition against bacteria or fungi.

In one embodiment, the composition is a pharmaceutical composition, which may be administered topically to a subject's skin.

The present invention is further illustrated by the following examples, which are provided for the purpose of demonstration rather than limitation.

6

Materials and Methods

Soil Sample Collection and Isolation of SC26

Soil samples were collected from the mountains in northern Taiwan and stored in sterile bags at 4° C. until use. The samples were sieved through 1-mm metal mesh, suspended in sterile water, serially diluted, plated on YM1 agar (0.4% Yeast extract, 1% malt extract), and incubated at 30° C. for 5 to 7 days. Individual colonies that produced spores were picked and streaked onto YM1 agar. Spores from these isolates were collected, suspended in sterile 20% glycerol, and stored at −80° C.

Morphology Under Electron Microscope

Spore chains of SC263 were collected from a 5-day culture growing on a cover slide on YM1 agar, fixed with liquid nitrogen, coated with gold particle, and observed under a Thermal Field Emission Scanning Electron Microscope (FE-SEM) JSM-7610F (JOEL Ltd., Tokyo, Japan).

Phylogenetic Analysis of 16S rRNA

Full-length 16S rRNA sequences was amplified by PCR using primers 27F and reverse primer 1492R and subjected to Sanger sequencing. The 16S rRNA sequence of SC263 was compared to the database on BLASTN web server at National Center for Biotechnology Information (NCBI). Sixty-two top hit sequences were ported to MEGA11 for alignment and phylogenetic tree construction [27,28].

Microbial Strains and Culture Conditions

The fungi used in antibiotic tests were *Aspergillus niger* ATCC 16878, *Aspergillus brasiliensis* ATCC 16404, *Candida albicans* ATCC 10231, *Candida tropicalis* ATCC 13803, *Nannizzia gypsea* ATCC 14683, and *Saccharomyces cerevisiae* BCRC 22286. Two Gram-positive bacterial used were *Bacillus subtilis* ATCC 6051 and *Staphylococcus aureus* ATCC 6538. Three Gram-negative bacteria used were *Escherichia coli* ATCC 8739, *Salmonella Typhimurium* SL1344, and *Salmonella Enteritidis* ATCC 13076.

Information of the further tested yeasts/fungi is provided in Table M below.

TABLE M

| | Further tested yeasts/fungi | | | |
|---|---|---|---|---|
| | Yeast/fungus | ATCC | BCRC | Note |
| 1 | *Aspergillus brasiliensis* | 16404 | 30506 | Mycotoxin |
| 2 | *Aspergillus flavus* | 9643 | 30144 | Most common *Aspergillus* infection |
| 3 | *Aspergillus niger* | 16878 | 32214 | Mycotoxin |
| 4 | *Candida albicans* | 10231 | 21538 | Multidrug-resistant |
| 5 | *Candida glabrata* | 2001 | 20586 | Multidrug-resistant |
| 6 | *Candida krusei* | 2143 | 23171 | Multidrug-resistant |
| 7 | *Candida tropicalis* | 13803 | 20521 | Multidrug-resistant |
| 8 | *Epidermophyton floccosum* | 18397 | 30531 | Skin and nail infection |
| 9 | *Hortaea werneckii* | | FU30545 | Epidermomycosis, ringworm |
| 10 | *Komagataella phaffii* | Strain: KM71H | | |
| 11 | *Microsporum canis* | 36299 | 30541 | Hong Kong feet/ringworm |
| 12 | *Nannizzia gypsea* | 14683 | 30542 | |
| 13 | *Saccharomyces cerevisiae* | | 22286 | |
| 14 | *Trichophyton mentagrophytes* | 9533 | 32066 | Multidrug-resistant |
| 15 | *Trichophyton rubrum* | 10218 | 32805 | Dermatophytes |
| 16 | *Trichosporon inkin* | | 21503 | Infection after surgery |
| 17 | *yarrowia lipolytica* | Strain: PO1g | | |

Further tested Gram-positive bacteria include *Bacillus subtilis* ATCC 6051 and *Staphylococcus aureus* ATCC 6538.

The test fungi were propagated on Sabouraud dextrose agar (SDA). The test bacteria were propagated tryptone soy agar (TSA). All bacteria and fungi were incubated at 30° C.

*Streptomyces* was cultured on solid YM1 agar and incubated at 30° C., or shaken in liquid YM1 broth at 30° C.

Cross Streak Screening for Antibiotic Activity

Actinomycete-like soil isolates were streaked on YM1 agar and incubated for 24 hours at 30° C. One microliter of the test bacteria or fungi containing $10^3$ colony-formation-unit (CFU) was spotted perpendicularly (FIG. 5A), and incubation was continued for four more days [29].

Zone of Inhibition Assays for Antibiotic Activities

All inoculants containing $10^5$ CFU each (except for *A. brasiliensis, A. niger*, and *N. gypsea*, which contained $10^6$ each) were spread on YM1 agar. Ten 11.1 of liquid containing the antibiotic (AF1) was spotted. For culture supernatant, the culture was grown at 30° C. for 24 hours and centrifuged at 12000 g for 5 minutes. The supernatant was collected and used for inhibition assays. For lyophilized powder, 0.1 g was dissolved in 1 ml sterile water. The plates were incubated at 30° C. for 5 days.

Membrane-Filtration Concentration of SC263

10 kDa and 100 kDa Centrifugal Filter Unit (AMICON) were used to identify the molecular weight of AF1. Two liters of SC263 culture supernatant was filtered through a 100 kDa mPES membrane (#D04-100 kDa, Repligen-Spectrumlabs) until the volume was reduced to 500 ml. The filtrated and the retained fractions were tested for antibiotic activities.

UV Mutagenesis of SC26

UV mutagenesis of *Streptomyces* was performed according to Kumar [31]. The surviving colonies were streaked onto a new plate and selected for late sporulating mutants.

Treatment with Lytic Enzyme

For cultured supernatant or F100 of SC263, proteinase K and pronase E were added to a concentration of 0.04 mg/mL and incubated at 37° C. for an hour. RNaseA or DNaseI were treated at 1 mg/mL and incubated at 37° C. for 0.5 hour. Pancreatin (Sigma-Aldrich) from porcine pancreas which composed of amylase, trypsin, lipase, ribonuclease and protease was added at 10 mg/mL 37° C. for an hour.

Genomic DNA Purification

SC263 was grown in YM1 at 30° C. for 3 days. The mycelia were harvested by centrifugation and washed in 10% sucrose. Genomic DNA was extracted according to Kutchma et. al. [32]. Purified genomic DNA was stored in TE buffer (10 mM Tris-HCl, 0.1 mM EDTA, pH 8.0) at −20° C.

Whole-Genome Sequencing

Genomic DNA was processed according to the assay protocol of PacBio CLR. The sequencing format is SMRT-cell sequencing via Sequel IIe platform. The sequence reads were assembled using SMRT Link (version 10.1.0.119588). The resulting three contigs achieved a QV score at least 91.39. Contigs with a score lower than 90 were removed.

Genomic Analysis

Annotation of the SC263 genome was conducted using NCBI Prokaryotic Genome Annotation Pipeline (PGAP), and the results were deposited to NCBI database with an accession number of JAKGSF000000000. Average nucleotide identity (ANI) was conducted using OrthoANI [22]. Genome-wide similarity comparison was conducted using Easyfig [33]. The presence of biosynthetic gene clusters was mined using anti SMASH 6.0 [23].

Results

Example 1: Isolation of Antibiotic-Producing SC26

A total of six soil samples from the mountain areas in northern Taiwan were screened for microbes on YM1 agar. Among colonies grown from these samples, isolate SC26 showed actinomycetes-like morphology including grey spores (FIG. 1A). Under field-emission scanning electron microscope (FE-SEM) SC26 displayed mycelia and coiled spore chains (FIG. 1B), characteristic of *Streptomyces*.

Figure 2:
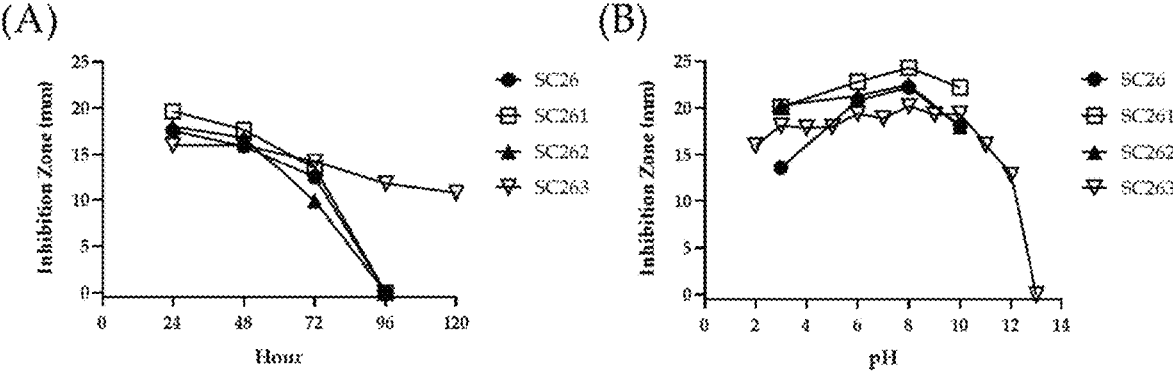
FIG. 2 shows the antifungal characteristics of SC26 and its derivatives. The antifungal activity of SC26 and its derivatives was examined using different fermentation hours until day 5 (A) and treated under different pH conditions from 24-hour cultured broth (B). All inhibition zones against *C. albicans* were measured.
Figure 3:
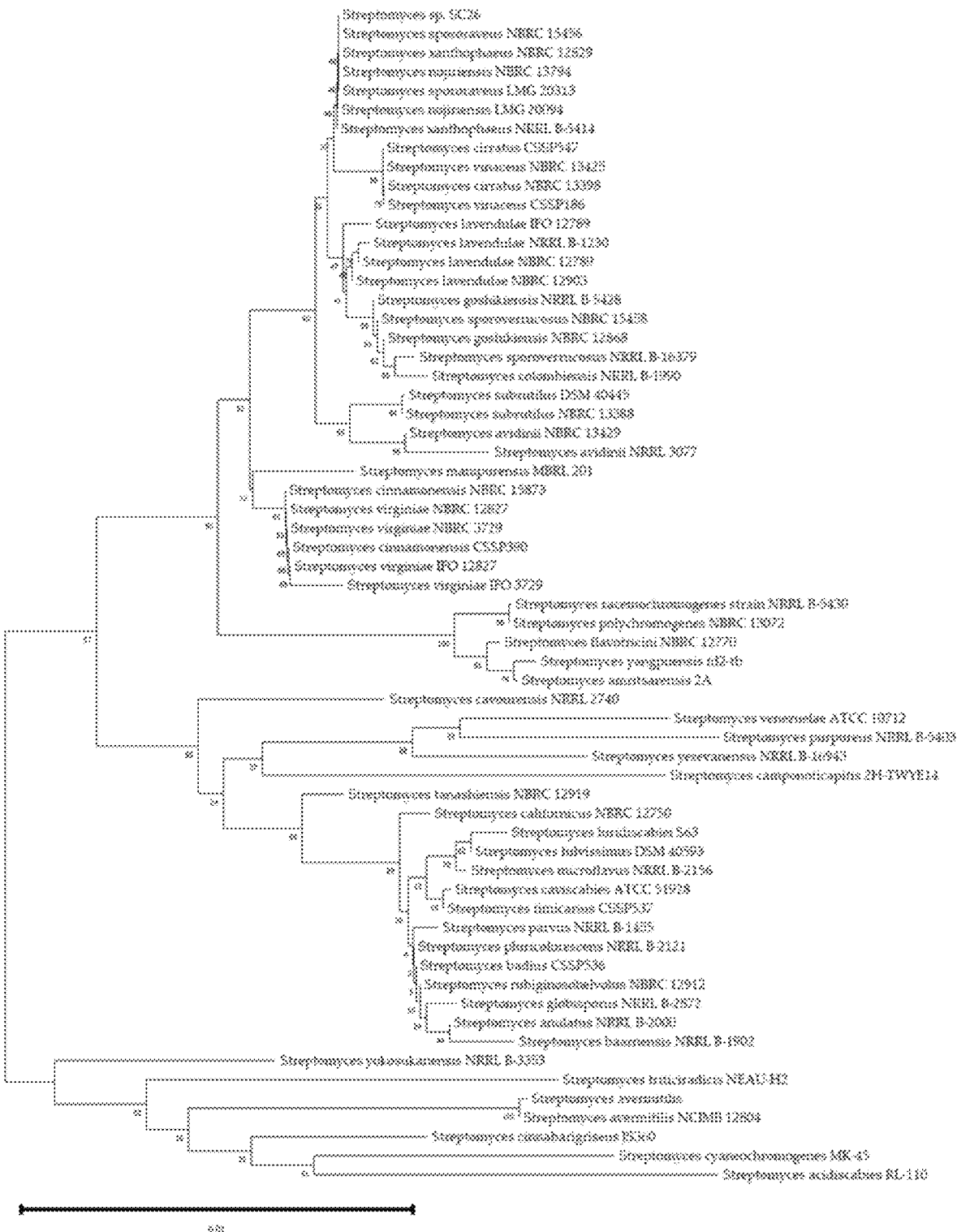
FIG. 3 shows a phylogenetic Tree of 16S ribosomal RNA of SC26. Maximum-likehood phylogenetic analysis was based on 16S rRNA gene sequences from 62 *Streptomyces*. The tree is drawn to scale, with branch lengths, indicating the number of substitutions per site between species using MEGA 11.

Culture supernatant of SC26 exhibited antibiotic activity against fungus *C. albicans* ATCC 10231 (FIG. 2A). The 16S rRNA sequence of SC26 was determined. Phylogenetic analysis showed that the SC26 16S rRNA was clustered into the same Glade as *Streptomyces spororaveus* NBRC 15456 and LMG 20313, *Streptomyces xanthophaeus* NBRC 12829 and NRRL B-5414, *Streptomyces nojiriensis* NBRC 13794 and LMG 20094 among 62 *Streptomyces* species compared (FIG. 3).

Example 2: Isolation and Characterization of UV-Mutagenesis Derivatives

The antibiotic produced by SC26 (designated AF1) was heat labile, destroyed in 3-5 hours at 65° C. (FIGS. 4A, 4B). UV mutagenesis of SC26 was conducted to search for strains producing relatively heat-stable AF1. Three mutant strains (SC261, SC262, and SC263) were chosen for their delayed sporulation (by 2 days compared to SC26). These mutants exhibited no difference in colony morphology and time course of AF1 production (FIG. 2A) from SC26.

Figure 4:
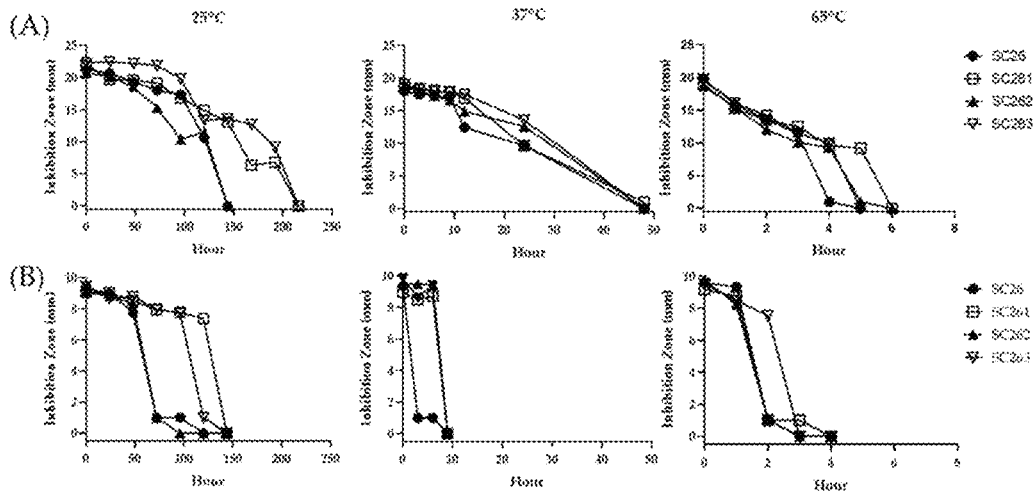
FIG. 4 shows the temperature stability of the bioactive compounds from SC26 and its derivatives. Overnight cultured broths from SC26 and its three derivatives (SC261, SC262 and SC263) were stored at 25° C., 37° C., and 65° C. Antimicrobial activity against *C. albicans* (A) and *S. aureus* (B) was measured at different time points.

Thermostability of AF1 produced by these mutants was conducted against *C. albicans* and *Staphylococcus aureus* ATCC 6538 (FIG. 4). AF1 produced by SC262 exhibited similar heat lability as that produced by SC26, whereas AF1 produced by SC261 and SC263 were stable for up to 192 hours at 25° C. against *C. albicans* and up to 144 hours against *S. aureus*. SC263 was chosen for further detailed studies.

Figure 5:
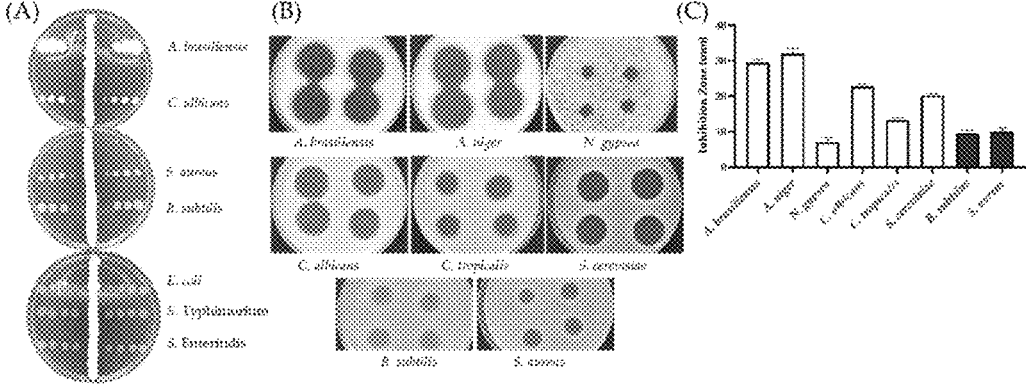
FIG. 5 shows the antibacterial and antifungal activities of SC263: (A) Antibiotic activity of SC263 using a cross-streak method for a 6-day incubation. An aliquot of 1 μL of bacterial suspension containing $10^3$ CFU were spotted cross the central line of SC263. (B) Ten-microliter of SC263 culture suspension was spotted in quadruplicates on lawns of test fungi and bacteria. *A. brasiliensis, A. niger*, and *N. gypsea*, was seeded with $10^6$ CFU each plate. The rest was seeded with $10^5$ CFU. (C) The diameters of inhibition zones were measured in triplicate. The error bars are calculated based on the quadruplicate zones for each tested microbe. White columns indicate fungi and black as Gram-positive bacteria.

A pH stability assay was conducted on AF1 of SC26 and its derivatives. AF1 of SC26 was relatively unstable at pH 3 and pH 10 compared with those by its derivatives (FIG. 5B). AF1 of SC263 was relatively stable from pH 2 to 12 but diminished at pH 13 to 14.

Example 3: Antimicrobial Activities of AF1 from SC263

AF1 of SC263 exhibited the same antibiotic spectrum as SC26, i.e., effective against two fungi (*Aspergillus brasiliensis* ATCC 16404 and *C. albicans*) and two gram-positive bacteria (*S. aureus* and *Bacillus subtilis* ATCC 6051), but not three Gram-negative bacteria (*Escherichia coli* ATCC 8739, *Salmonella Typhimurium* SL1344, and *Salmonella Enteritidis* ATCC 13076) (FIG. 5A).

In addition, AF1 of SC263 also inhibited four other fungi, *Aspergillus niger, Candida tropicalis, Nannizzia gypsea*, and *Saccharomyces cerevisiae* (FIG. 5C). The largest inhibition zone was found in *A. niger* with an average diameter of 32.0 mm, and the smallest was found in *N. gypsea* with 7.1 mm in diameter (FIG. 5C).

These inhibition zones produced by AF1 on the two Gram-positive bacteria were opaque (FIG. 5B), containing minute colonies which were able to grow when transfer to a new plate. In comparison, the inhibition zones in the fungal plates contained no viable cells. This suggests that the activity of AF1 against the two Gram-positive bacteria is bacteriostatic, not bactericidal.

Figure 9:
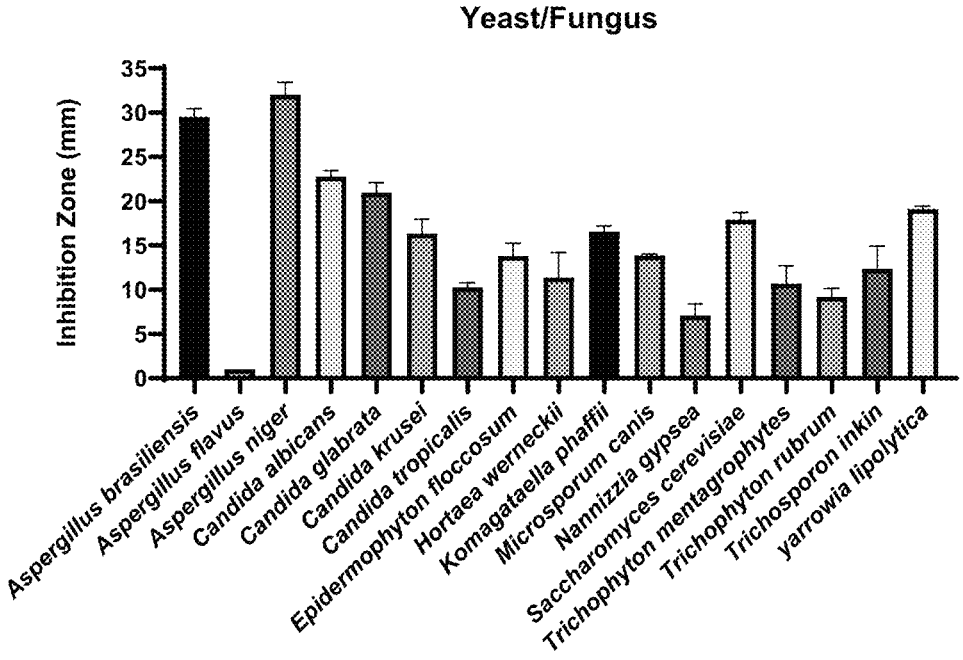
FIG. 9 shows the results of inhibition zone experiments for several yeasts/fungi.
Figure 10:
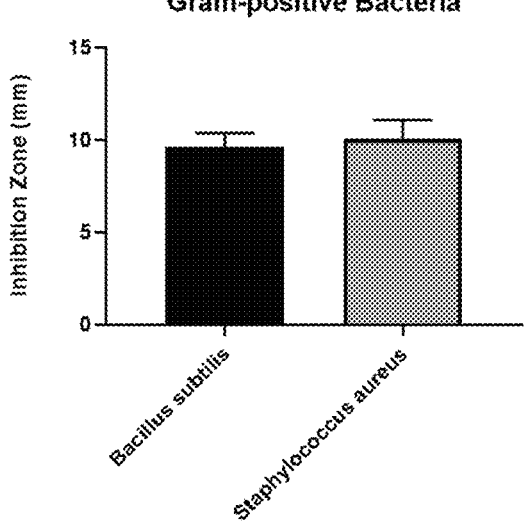
FIG. 10 shows the results of inhibition zone experiments for two Gram-positive bacteria.

Test results for more yeasts/fungi are shown in FIG. 9, and test results for two more Gram-positive bacteria are shown in FIG. 10.

Example 4: Characterization of the SC263 Antibiotics by Membrane-Filtration

Figure 6:
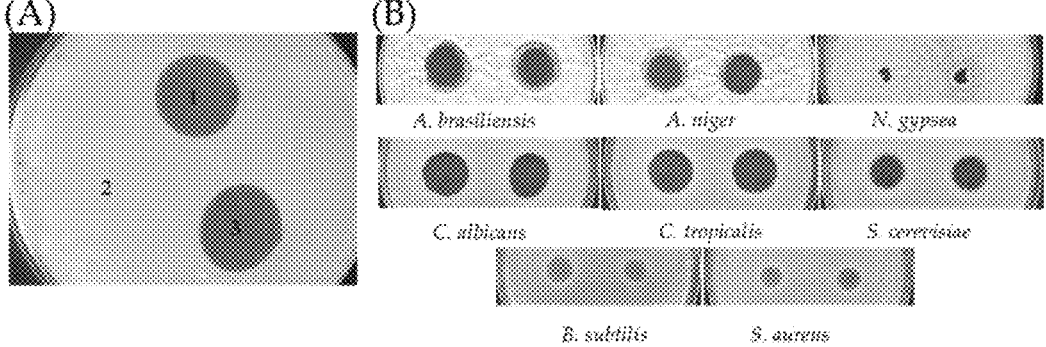
FIG. 6 shows the antibiotic activities of SC263 membrane filtrate. (A) Different fractions of SC263 cultured broth were tested against *C. albicans*. 1: culture broth; 2: filtrate<100 kDa; 3: compounds>100 kDa (F100 Fraction). (B) Reconstituted lyophilized powder was tested for zone of inhibition in duplicate spots against different fungi and Gram-positive bacteria.

To estimate the size of the AF1 in SC263, we filtered the cultured broths through a 10-kDa and a 100-kDa pore-size membrane. The active compound was absent in the filtrate, but present in the >100 kDa fraction (designated 'F100'; FIG. 6A). F100, when lyophilized and reconstituted, exhibited the same antibiotic spectrum as the culture supernatant (FIG. 6B).

The antibiotic in SC26 broth yielded the same sizing results. The large apparent size of AF1 distinguishes it from the majority of known antibiotics, which are mostly small metabolites [16]. Most known antifungal antibiotics are below the molecular weight of 2000 Da [5].

Figure 7:
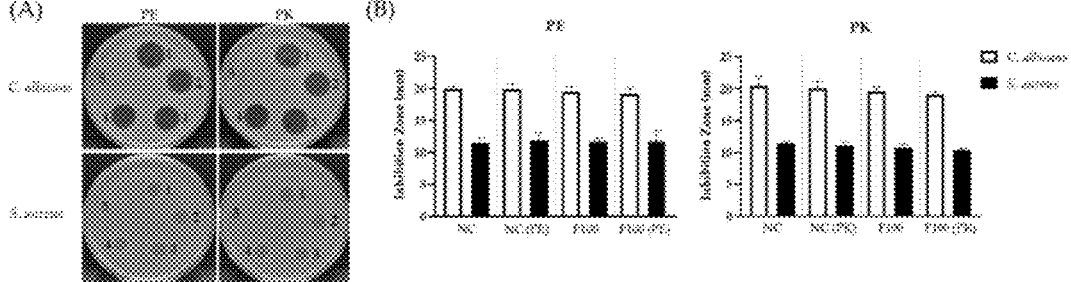
FIG. 7 shows the protease treatment of AF1 and F100 from SC263. (A) Antibiotic activities of AF1 and F100 individually treated with proteinase K (PK) or pronase E (PE) were examined. Numbers in this image indicate different treatment conditions as below. 1: AF1. 2: F100. 3: AF1 treated with PE or PK. 4: F100 treated with PE or PK. 5: PE or PK in sterile water. (B) The diameters of inhibition zones were measured.

Many large antifungal natural products are proteins [17, 18]. Treatment of the SC263 broth and F100 with either proteinase K or pronase E did not eliminate the antibiotic activity (FIG. 7), suggesting that the AF1 is not a protein. Treatment with DNaseI, RNaseA, or pancreatin (which composes of amylase, trypsin, lipase, ribonuclease, and protease) also did not extinguish the antibiotic activity of AF1 (data not shown).

Example 5: Genomic Sequence of SC263

To identify taxonomically SC263 and to investigate the secondary metabolic repertoire of SC263, whole genomic sequence of SC263 was determined. Three contigs, Ctg1 (7,201,269 bp), Ctg2 (996,243 bp), and Ctg3 (20,182 bp), were produced (Table 1). The overall GC content of 71.92%.

TABLE 1

| Genome Features of SC263 | |
| --- | --- |
| Feature | Characteristics |
| Number of Contigs | 3 |
| Total GC Content | 71.92% |
| Length (base pair, bp) | 8,217,694 |
| Ctg1 | 7,201,269 |
| Ctg2 | 996,243 |
| Ctg3 | 20,182 |
| Number of Genes | 7,370 |
| Number of RNAs | 91 |
| rRNA | 21 |
| tRNA | 73 |
| ncRNA | 3 |
| Number of Subsystems | 319 |
| Number of Pseudogenes | 197 |
| Number of BGCs | 28 (see Table 2) |

A total of 7,370 genes and 137 pseudogenes were annotated. Ninety-one RNAs, including 7 rRNAs, 73 tRNAs, and 3 non-coding RNAs were predicted. An origin of chromosome replication oriC was centrally located between dnaA and dnaN genes on Ctg1 (position 3,676,752-3,677,627) [19-21].

Four genomes in the same 16S rRNA Glade were used for pairwise comparison with SC263. The average nucleotide identity (ANI) values against *S. spororaveus* NBRC 15456, *S. nojiriensis* NBRC 13794, *S. xanthophaeus* NBRC 12829 and NRRL B-5414 were 99.57, 92.88, 86.57, 86.47, respectively. We therefore classified SC263 as *Streptomyces spororaveus*. Genome-wide comparison shows relatively high synteny between SC263 and NBRC 15456.

Example 5: Biosynthetic Gene Clusters in SC263

To assess the biosynthetic potential of secondary metabolites in SC263, we used antiSMASH webserver [23] to predict possible biosynthetic gene clusters (BGCs) on its genome. Ctg1 contained 21 predicted BGCs, Ctg2 contained 7, and Ctg3 contained none (Table 2). None of the predicted secondary metabolites produced by these BGC are larger than 2,000 Da.

TABLE 2

| | | | *S. spororaveus* SC263 | | *S. spororaveus* NBRC 15456 | |
| --- | --- | --- | --- | --- | --- | --- |
| BGC Type | Most similar known cluster | Notes | Region | Similarity | Region | Similarity |
| NRPS-like | lipstatin | NRP | 1-1 | 42% | 1 | 35% |
| T2PKS | spore pigment | Polyketide | 1-2 | 66% | 2 | 66% |
| NRPS, NRPS-like | JBIR-126 | NRP | 1-3 | 92% | 3 | 96% |
| NRPS, T1PKS | coelichelin | NRP | 1-4 | 72% | 4 | 72% |
| butyrolactone | neocarzinostatin | Polyketide: type I | 1-5 | 4% | 5 | 4% |
| NRPS, T1PKS | versipelostatin | Polyketide | 1-6 | 14% | 6 | 8% |
| siderophore | desferrioxamin B | Other | 1-7 | 100% | 7 | 100% |
| phenazine | lomofungin | Other | 1-8 | 34% | 8 | 34% |
| LAP | | | 1-9 | | 9 | |
| CDPS | BD-12 | NRP | — | — | 10 | 17% |
| siderophore | ficellomycin | NRP | 1-10 | 5% | 11 | 5% |
| T1PKS | ECO-02301 | Polyketide | 1-11 | 82% | 12 | 82% |
| NRPS-like | meoabyssomicin/ abyssomicin | Polyketide | 1-12 | 12% | — | — |
| NRPS-like, T2PKS | polyketomycin | Polyketide: type I + Type II | 1-13 | 39% | 13 | 41% |
| RiPP-like | | | 1-14 | | 14 | |
| terpene | toxoflavin/ fervenulin | Other | 1-15 | 14% | 15 | 14% |
| lanthipeptide-class-iv | | | 1-16 | | 16 | |

TABLE 2-continued

| | | | S. spororaveus SC263 | | S. spororaveus NBRC 15456 | |
|---|---|---|---|---|---|---|
| BGC Type | Most similar known cluster | Notes | Region | Similarity | Region | Similarity |
| NRPS | nogalamycin | Polyketide | 1-17 | 30% | 17 | 30% |
| terpene | hopene | Terpene | 1-18 | 61% | 18 | 61% |
| ectoine | ectoine | Other | 1-19 | 100% | — | — |
| lanthipeptide-class-I | | | 1-20 | | — | — |
| TIPKS, hglE-KS | saframycin A/ saframycin B | NRP | 1-21 | 4% | 19 | 4% |
| lanthipeptide-class-iii, terpene | SapB | RiPP:Lanthipeptide | 2-1 | 100% | 20 | 100% |
| terpene | 2-methylisoborneol | Terpene | 2-2 | 100% | 21 | 100% |
| terpene | monensin | Polyketide | 2-3 | 5% | 22 | 5% |
| melanin | melanin | Other | 2-4 | 28% | 23 | 28% |
| siderophore | | | 2-5 | | 24 | |
| T3PKS | alkylresorcinol | Polyketide | 2-6 | 100% | 25 | 100% |
| CDPS, NAPAA | | | 2-7 | | 26 | |

Figure 8:
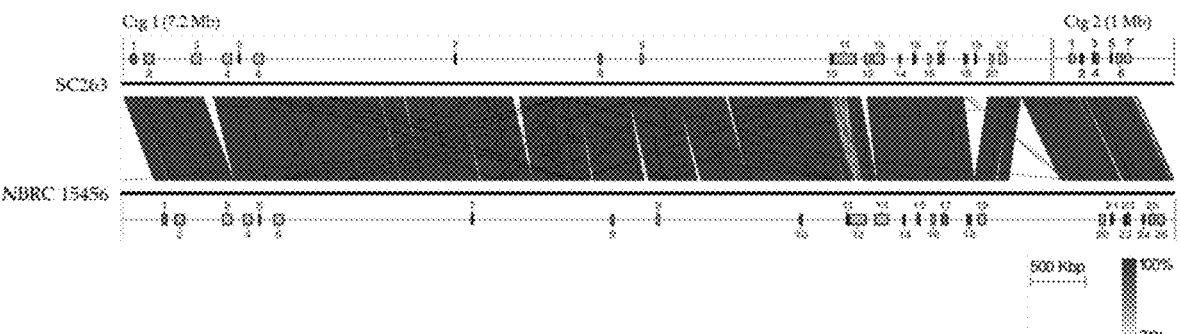
FIG. 8 shows the genome comparison between SC263 and *Streptomyces spororaveus* NBRC 15456. Biosynthetic gene clusters (BGCs) were predicted using anti SMASH 6.0 webserver and numbered by the order of these two strains in the top and bottom lines, respectively. Genome comparison between these two strains was generated using EASYFIG v. 2.2.5 and placed in the center.

The BGCs on the SC263 genome showed high similarity with those on the NBRC 15456 genomes (FIG. 8). Compared to the NBRC 15456 genome, the SC263 genome contained three additional BGCs: meoabyssomicin/abyssomicin (Region 1-12), ectoine (Region 1-19), and lanthipeptide-class-I (Region 1-20).

Interestingly, another closely related strain, *S. spororaveus* RDS28, which was isolated in Saudi Arabia, also exhibits an antifungal activity to many plant pathogens [24]. The nature of this antibiotic(s) is unknown.

In summary, *S. spororaveus* SC26 was isolated in northern Taiwan, which produces an antibiotic (AF1) against 6 fungi and 2 Gram-positive bacteria. From SC26, a mutant SC263 was isolated, which exhibited increase thermostability of AF1. AF1 produced by these strains is unusual in its apparent molecular weight, its dual antifungal and antibacterial activities. AF1 is a novel antibiotic which is resistant to proteolytic digestion.

The genomic sequences of SC263 contained 28 predicted BGCs, none of which appears to be involved in production of secondary metabolites larger than 2000 Da. Antibiotics with very high molecular weights are difficult to penetrate the skin barrier and are potentially safer for topical administration [34].

All publications, patents, and patent documents cited herein above are incorporated by reference herein, as though individually incorporated by reference.

The invention has been described with reference to various specific and preferred embodiments and techniques. However, one skilled in the art will understand that many variations and modifications may be made while remaining within the spirit and scope of the invention.

REFERENCES

1. Toner, E.; Adalj a, A.; Gronvall, G. K.; Cicero, A.; Inglesby, T. V. Antimicrobial resistance is a global health emergency. *Health Secur* 2015, 13, 153-155, doi:10.1089/hs.2014.0088.
2. Organization, W. H. *Global Action Plan on Antimicrobial Resistance;* 2015.
3. Healey, K. R.; Zhao, Y.; Perez, W. B.; Lockhart, S. R.; Sobel, J. D.; Farmakiotis, D.; Kontoyiannis, D. P.; Sanglard, D.; Taj-Aldeen, S. J.; Alexander, B. D.; et al. Prevalent mutator genotype identified in fungal pathogen *Candida glabrata* promotes multi-drug resistance. Nat Commun 2016, 7, 11128, doi:10.1038/ncomms11128.
4. Segal, B. H.; DeCarlo, E. S.; Kwon-Chung, K. J.; Malech, H. L.; Gallin, J. I.; Holland, S. M. *Aspergillus nidulans* infection in chronic granulomatous disease. *Medicine (Baltimore)* 1998, 77, 345-354, doi:10.1097/00005792-199809000-00004.
5. McKeny P T, N. T., Zito P M. Antifungal Antibiotics. 2021.
6. Ostrosky-Zeichner, L.; Rex, J. H.; Pappas, P. G.; Hamill, R. J.; Larsen, R. A.; Horowitz, H. W.; Powderly, W. G.; Hyslop, N.; Kauffman, C. A.; Cleary, J.; et al. Antifungal susceptibility survey of 2,000 bloodstream Candida isolates in the United States. *Antimicrob Agents Chemother* 2003, 47, 3149-3154, doi:10.1128/AAC.47.10.3149-3154.2003.
7. Mehrad, B.; Paciocco, G.; Martinez, F. J.; Ojo, T. C.; Iannettoni, M. D.; Lynch, J. P., 3rd. Spectrum of *Aspergillus* infection in lung transplant recipients: case series and review of the literature. *Chest* 2001, 119, 169-175, doi:10.1378/chest.119.1.169.
8. Eriksson, U.; Seifert, B.; Schaffner, A. Comparison of effects of amphotericin B deoxycholate infused over 4 or 24 hours: randomised controlled trial. *Bmj* 2001, 322, 579-582, doi:10.1136/bmj.322.7286.579.
9. Patil, A.; Lakhani, P.; Majumdar, S. Current perspectives on natamycin in ocular fungal infections. *Journal of Drug Delivery Science and Technology* 2017, 41, 206-212.
10. Chassagne, F.; Cabanac, G.; Hubert, G.; David, B.; Marti, G. The landscape of natural product diversity and their pharmacological relevance from a focus on the Dictionary of Natural Products®. *Phytochemistry Reviews* 2019, 18, 601-622, doi:10.1007/s11101-019-09606-2.
11. Hutchings, M. I.; Truman, A. W.; Wilkinson, B. Antibiotics: past, present and future. *Current Opinion in Microbiology* 2019, 51, 72-80.
12. de Lima Procopio, R. E.; da Silva, I. R.; Martins, M. K.; de Azevedo, J. L.; de Aranjo, J. M. Antibiotics produced by *Streptomyces. The Brazilian Journal of Infectious Diseases* 2012, 16, 466-471.
13. Watve, M. G.; Tickoo, R.; Jog, M. M.; Bhole, B. D. How many antibiotics are produced by the genus *Streptomyces? Arch Microbiol* 2001, 176, 386-390, doi:10.1007/s002030100345.

14. Nicault, M.; Tidjani, A.-R.; Gauthier, A.; Dumarcay, S.; Gelhaye, E.; Bontemps, C.; Leblond, P. Mining the Biosynthetic Potential for Specialized Metabolism of a *Streptomyces* Soil Community. *Antibiotics* 2020, 9, doi: 10.3390/antibiotics9050271.

15. Eom, S. H.; Kim, Y. M.; Kim, S. K. Marine bacteria: potential sources for compounds to overcome antibiotic resistance. *Appl Microbiol Biotechnol* 2013, 97, 4763-4773, doi:10.1007/s00253-013-4905-y.

16. Awad, H.; El-Shahed, K.; Aziz, R.; Sarmidi, M.; El Enshasy, H. Antibiotics as Microbial Secondary Metabolites: Production and Application. *Journal Tekologi* 2012, 59, 101-111, doi:10.11113/jt.v59.1593.

17. Garrigues, S.; Gandia, M.; Castillo, L.; Coca, M.; Marx, F.; Marcos, J. F.; Manzanares, P. Three Antifungal Proteins From *Penicillium expansum*: Different Patterns of Production and Antifungal Activity. *Frontiers in Microbiology* 2018, 9, doi: 10.3389/fmicb 0.2018.02370.

18. Selitrennikoff, C. P. Antifungal proteins. *Appl Environ Microbiol* 2001, 67, 2883-2894, doi:10.1128/ AEM.67.7.2883-2894.2001.

19. Messer, W. The bacterial replication initiator DnaA. DnaA and oriC, the bacterial mode to initiate DNA replication. *FEMS Microbiol Rev* 2002, 26, 355-374, doi:10.1111/j.1574-6976.2002.tb00620.x.

20. Jakimowicz, D.; Majka, J.; Messer, W.; Speck, C.; Fernandez, M.; Cruz Martin, M.; Sanchez, J.; Schauwecker, F.; Keller, U.; Schrempf, H.; et al. Structural elements of the *Streptomyces* oriC region and their interactions with the DnaA protein. *Microbiology (Reading)* 1998, 144 (Pt 5), 1281-1290, doi:10.1099/00221287-144-5-1281.

21. Rajewska, M.; Wegrzyn, K.; Konieczny, I. AT-rich region and repeated sequences—the essential elements of replication origins of bacterial replicons. *FEMS Microbiol Rev* 2012, 36, 408-434, doi:10.1111/j.1574-6976.2011.00300.x.

22. Yoon, S. H.; Ha, S. M.; Lim, J.; Kwon, S.; Chun, J. A large-scale evaluation of algorithms to calculate average nucleotide identity. *Antonie Van Leeuwenhoek* 2017, 110, 1281-1286, doi:10.1007/s10482-017-0844-4.

23. Blin, K.; Shaw, S.; Kloosterman, A. M.; Charlop-Powers, Z.; van Wezel, G. P.; Medema, M. H.; Weber, T. antiSMASH 6.0: improving cluster detection and comparison capabilities. *Nucleic Acids Res* 2021, 49, W29-W35, doi:10.1093/nar/gkab335.

24. Al-Askar, A.; M, A.; Rashad, Y. In vitro antifungal activity of *Streptomyces spororaveus* RDS28 against some phytopathogenic fungi. *African journal of agricultural research* 2011, 6, 2835-2842.

25. Frank, J. A.; Reich, C. I.; Sharma, S.; Weisbaum, J. S.; Wilson, B. A.; Olsen, G. J. Critical evaluation of two primers commonly used for amplification of bacterial 16S rRNA genes. *Appl Environ Microbiol* 2008, 74, 2461-2470, doi:10.1128/AEM.02272-07.

26. Boratyn, G. M.; Thierry-Mieg, J.; Thierry-Mieg, D.; Busby, B.; Madden, T. L. Magic-BLAST, an accurate RNA-seq aligner for long and short reads. *BMC Bioinformatics* 2019, 20, 405, doi:10.1186/s12859-019-2996-x.

27. Tamura, K.; Stecher, G.; Kumar, S. MEGA11: Molecular Evolutionary Genetics Analysis Version 11. *Mol Biol Evol* 2021, 38, 3022-3027, doi:10.1093/molbev/msab120.

28. Edgar, R. C. MUSCLE: multiple sequence alignment with high accuracy and high throughput. *Nucleic Acids Res* 2004, 32, 1792-1797, doi:10.1093/nar/gkh340.

29. Kumar, P. S.; Raj, J. P.; Duraipandiyan, V.; Ignacimuthu, S. Antibacterial activity of some actinomycetes from Tamil Nadu, India. *Asian Pac J Trop Biomed* 2012, 2, 936-943, doi:10.1016/s2221-1691(13)60003-9.

30. Bhargav, H. S.; Shastri, S. D.; Poornav, S. P.; Darshan, K. M.; Nayak, M. M. Measurement of the Zone of Inhibition of an Antibiotic. In Proceedings of the 2016 IEEE 6th International Conference on Advanced Computing (IACC), 27-28 Feb. 2016, 2016; pp. 409-414.

31. Kumar, A. K. UV mutagenesis treatment for improved production of endoglucanase and β-glucosidase from newly isolated thermotolerant actinomycetes, *Streptomyces griseoaurantiacus. Bioresources and Bioprocessing* 2015, 2, 22, doi:10.1186/s40643-015-0052-x.

32. Kutchma, A. J.; Roberts, M. A.; Knaebel, D. B.; Crawford, D. L. Small-scale isolation of genomic DNA from *Streptomyces* mycelia or spores. *Biotechniques* 1998, 24, 452-456, doi:10.2144/98243st05.

33. Sullivan, M. J.; Petty, N. K.; Beatson, S. A. Easyfig: a genome comparison visualizer. *Bioinformatics* 2011, 27, 1009-1010, doi:10.1093/bioinformatics/btr039.

34. Bos, J. D.; Meinardi, M. M. The 500 Dalton rule for the skin penetration of chemical compounds and drugs. *Exp Dermatol* 2000, 9, 165-169, doi:10.1034/j 0.1600-0625.2000.009003165.x.

SEQUENCE LISTING (3 sequences)

SEQ ID NO: 1 - DNA, 996243 bp, Streptomyces sp.
  source 1..996243: mol_type = genomic DNA
actacgggcccgagaggtcggtgacatgacagcccgccgctccatgcgggagctggacagggccgaggccctgcggctgctctcgacggtgtccctggggcgcatcgtcttcacacagcacgcgctgcccgccgtccgcccggtgaaccatctcgtcgagaacgaggccatcatcgtccggatacatgaggacggggcattggcctccctggtggcacccgccgacgctcccggtgtggtggtggcctacgaagcggacgtcatcgattccgtcacgcacctcggttggagcgtcgtcgtcaccggttacgcgagggtggtggcagatgccgacgaggtggaccggtacgcgcacctgctgcgtccatgggtggcgcaccggatgaccagcaccctgcggatccgtccggatctcgtcaccgggttccggctggaagcggacccgacgcagcccgtgcccgcggcccggggctgacgcccttgccccggtcctcagcccccggtggagaggggagcccgccagacgagccttgtacccccgtcatccggagtttcgtgagtgaaggagccgcccaggctctgcgcccgctcgtcgaggttgcgcaggccgcttctgcggccttgggccggaatgcccttcccgttgtccgagacggtcagcacgacctcgccccggccggccttgagggtcacgccgacccgggtcgcctgtgcgtggcgggcggcgttgctgaggagttcgcccagtaccgccatgacgtggtcggcgatctgcgggggtacgtcggtgtcgagcaggccttccatgctcaggcgcggcgggtgaccgagggtggtggccgcgtcgccgacggcacgggcggcgcgtgcccgcagaccagggccgccctcgcggtccttggtacgcagcccgaagatcgtcgaccggatgatcttgatcgtttcgtccaggtcgtcgaccgcccggccgaccctttcggcggccccgtcgtgctcgacgagccgagcggcgctctgcagggtcatgccggtggcgaagagccgctggatggccaggtcgtgcaggtcgcgggcgatccggtcgcgctcctccagcagtgctatctgctcggcgtcccggcgccgctccgccagctccagcgcgagtgcggcctgacccgcgaaggcgacgaggggctccagctcgccctcgccgaacgccggttctcccgacgcgcgcgcaagcagcaggacacctctgctttcgccgcccgcggtgcccaacgggacggccacggcgggccccaacccttcctgaacctgggactcagcgggatagcgctcgtcggcccaggccggcaccgctgtgacgggtttgccggccaggtgcgccgctcctgcgagcgtgcccgcgaaggggacgacgagaccttgcctctcggctccgtccgcgtcggccgcgaactccacgaccaggccgtcgataccggtcacgggcatggcgatgtccgcgaggcgtgccgcggtgatctcttgtgcgcggcgggcgatgagctccagcaccgccgggcgggagctgccggacagcaggctttcggtgatctccgcattggccttgagccatcgctgctggcgctgcgagccctcgtagagccgcgcgttgtcgatcgcgacacccgccgccaccgagagggtggagatcaccgtctcgtcctcggtgtcgaagtcgatcccgccacgcttgtcggtcagatagagattgccgaacacctcctcgcggacccggatcggcacaccgaggaaggtgcgcatgggcgggtgatgggccggaaagccgtgggaagaggagtgcgcgccgagatcggtgaggcgcagtggctccgggtggtggatgacctccccgagcaggccgtggcccgccggcaggggaccgatctcggtgatctccgcatccgtgagccccacggtcaggaactgcgaaagcgtgcggccgtcggggccgatcactcccagagcgccgtattcggcgtcgacgagcagcgcggccgcctccacgatccgccgcagcacctgggcgagatcaagctcccgccccaccgacaccacggcctccaggaggctgtgcacccggtcccgcgtaccgcgcacttcgtcgatgcgcacctggagctcgtccagcagctcgtccaaccgcatccgcggtacccgggtcaacggatcccccacacccacgcgcttcccctccgacggccgctcggttgcccgatccacggtcagcgtatcgacacgccggggcccgatgggcgtcgttgcgcgcggatggccgccgtgactgactttgatcgaaacgcacgacgacggggaggatgcgccatgggtctgaagaaggcggtctacgaggacgagctgctacggctccagacggagctgatcaaactccaggagtgggtacgtgcggagggcgcccggttggtggtcgtcttcgagggccgtgacgcggcgggcaagggaggcacgatcaagcgggtcgcggaacacctcaacccccgtgtcgcacgcatcacggccctgcccacgccgacggaacgggagcgcagccagtggtacttccagcgctacgtcgagcacctgcccgccgccggcgagatcgtcctgttcgaccgcagctggtacaaccgcgccggagtcgagcacgtcatgggcttctgcacaccggcggaacaccggctcttcctgcgccagtgtccggtcttcgagcacatgctcgtcgaagacgggatcctgctccgcaagtactggttctccgtcagcgacgcagtgcaggaggagcggttccgcgcccgggcgaaggacccgctgcggcgctggaagctctccccgatggacctggagtccctcacgcgctgggaggcgtactcgcgggccaaggatgaaatgctcgtccacaccgacacggcggacgccccctggtacgtggtcgagagcgacgacaagcgcagcgcgagactcaacatgatcgcccacctgctgtcctcgcttccctacgcggacgtggccctgccgtcgctcaccctgccgccccgtcctccttccacgggataccagcgacctcccaaggacctccagaacgccgtccccgaccatgcgtccacgctcgggaacgactgaagcgcggcagattccgacgcggagtcgccaagtgcaccgtcagcgaggagcgcgatgtccgcacgtggaaggccgtccctgctgcccctcggtctcagggggtaccgtcgggcgtggctcggtcgggacgcactggccggaatcgccgtggccgcctatctggtgccccaggtcatggcctatgcgggggtggccgggctgccaccggtcgcgggactctgggccgtgctgcccgccatggtgctctacgcctcgatcggttcctcacggctgctctcggtgggacccgagtcgaccaccgcgctgatgacggccgtcgccgtggggccgctcgcaggaggggacccgggccggtacgcggtgctcgcggcggccctcgccgtggtcgtcggcctggtgtcgctggcggcctgggccgtgcgcctcgggtttctcgccgacctgctctcacggcccgtgctcgtcggctacctcgccggtgtcgccctgatcatgatcgtcgaccagctgccccggctcaccggagtacgagccaccggctccggcttcttcacacagctgtacaccttcgccctcaacgtctcgcacgttcactggccgaccgtcgtcctggccgccgccgtgctggtcctgctcctggtggcgccgaggtactggcggacggttccgcgtcccctgctcgcccttgtcgccgtcaccgccctggtggcggcattcgggctggacgagcggtacgggatcgccgtgatcggatccgtaccctccgggctgcccgtgcccgcgctgccgccccccggcgaccttccgcagctggtgatcccggcgctgggcgtccttctcgtcggctactcggacgtgatcctcaccgcccgggccttcgccgaccggggcgacccgcttccgctcgaccccaaccgtgagctgctggccctgggggcggcgaacctgggggcgggcctcatgtacgggttccccgtcagcagcagcgccagccgcaccgcgttggcccagtcggcgaaggcgcggagccaggcctactccctgttcgccgcactcgcggtactgatggtcctcctcttcctggggccgctcctggcccacaccccgagcgccgtcctcggcgccatcgtcgtctacgccgccgtccgcctcgtcgaagtgggcgagttccggcgtctcgcggccttccgccggcgcgagctgctgctggcactcggatgcctcctgggcgttctggccctcggcatcctgtacggagtgctcgtcgccgtgaccctgtccgtggtcgagttgctggcccgtgtggcccgcccgcacgacgccgtggaaggcatggtgcccgggctcgccggcatgcacgacgtggacgactacccgacggcgcggacggttccggggctgctgatctaccgctacgactcgccgctgttcttcgccaacgcggagaacttccgccgccgtgccctggcagcggtcgacgggcagcggtctccgacgcgctggttcgtcctcaacaccgaggcgaacgtggaggtggacatcacggcactggacgccgtggagacactccgccaggaactcgaggaccgcggcatcgtcctcgccctggccagggtcaaacaggaactccgcgaggacctggacgcttacggcctgaccgcctcggtgggcgccgaccgcatctacccgaccctgcccacggctctggaggcctatcgggcatggagccgcggggcagggttcgcggcggaatgagcaggaccacgcgtagtgctgcggttggatcggctcgccttcgcgctgctcgtggcagtcgagcgtcggttgttgccgagctcggcgggcaggaacggcccggaggggcgcgccgggcttcaggccccggaggccgacccggcagtcaccgggccgaccccacgtcccgtccgtgtcagcccgtgtcagtccgcgagcctgaggccgaaccgttcgaagatgtcgcccacttcgatccagcccacctcgtaacggcagaccctgtcgttgccgacgccctcacagccccacgcattgacgaccatgccgttcagctgccgggagtcctggtcgttgatggtgatcacggggccgccgctgtcgccgggccgggcgacgatgccgccgttgtgcgggacgccggcgcttccccagacgtacgcgctttcggtcacccaggtggcgctgcccgcgtaagtggtacggatgttgcagacgaccttggagttgtagccgagttggcaggtgaagtcgcccaccgccgcgttgcgtacgccgttgaggcggcgggtgtacccctgcgcgtcgaggccgtcccacgtgtagcggctcgccggcgccgcgatgaacgccgagtcgaggtcggcgatctcggcttcgatctggccgacgcggaagccgcccgcagtgaagacggtcgcgccggggccatagcagtggcccgcggtgacgagccactggcggttgtccacggtgcttactgcagggattccgctggtgcatgtggcgaacgagccgctcgcgggtccgagcgcggcccctgcgtagaacggcgcccggtcgtcccaccggctcagcggcaccgagggagcggacgcgcggatgcggatgggggtggctcgggctgccgcgagctgctgggcgacggcgggccctgcgaggtacttctgcgcggcccgcgcgtcgtccacggcgagctcgatcgctccgccgtcgacggtgctgcccgccatctcgatcttgaagggcaggtccttgcggctgcggaagtccgtgatctccttcctgagctgcagcagcgtcttcgcgctcgtgcgcacgttcagcagcttcgtgtcggccttcgggttggccttgcgcaccgcgtcgaggaaggcagggccccgttgcggatcggtgaggtagacgttgaccgagcggtagtcggaggccatctcgacctgtgtgtacacgtccgcgtgcggcccccggccggccctcgcggcggcgtcggccacgacccgcaggggttccagtacctcgccttgctgttgtggcgtcatggccgcgacgacgtctgcggacaggggcccgggcggctccgcttcggcggccggcgctccgagtggaaggacggcgagcacggtcgcgagcgcgagcgaacgccaagcagccttgttcatagatccccttacagtgactgtgtgtgcacaatgtgtacgctgcgtgaccgtagtgagtgtccgaaatgcgcggcaagggcgcgcggctgcccttgggggcacatggggggcgtgtggacgtccgcgcgcgcccagttcctcggcggcgaccgcgcatgggtccgccggcactccgtgaacagtgagggcacacgccgaggagggatccgcgtcgaggtatccccgccgggggaggggagcggttctccggcgtctcagtcgggtgtgctccgcctctccgcatcggcctgccgccactgctcggccgcctcgatcatggtccggccgacgtgctcgaagaagtggcccatgtcctgcatccgggtgccggcgggtgtcgtggtgccgaggacctgggcgccgcgcagggtgaagtcggccagcatggcgttctggcgggcgctggccatccagccgcggaaccaggcgtcggcgtcgatcacgtaccggtcgcgccgccggccggggtcgcgttcgcgcctgatgagctcctgctgttcgagttcgccgacggccttggagacggaggcggggctgaccttgaggcgctcagcgagctcggtggcggtcaggctgcccccatcggtgacgtacaggcacgtgagcactcgggcggtcatccgcgggagaccggtggcgaccatcatcgccgtgaactgttcctccagttcgaggacggcctccgggtcgcgtccgtgcatgccgcccgcggtcgtggcggcggccggggccgtgggctgcttgcggcggcgggcgcgtcctgtcgtggcgcgatgggccgcgtcggcccgataggcggtcgggccgccgttgcgggccacctcccgggtgacggtggagatgggcctgcccaggcgcccggcgatgtcggtgtagctgagtccttgccccaacccctcggcgatcgcctgtcgttcgtggtgggtcagtctgcctccgggcatcgccattgcctccgtgtcgggtccgcgtgtgcggccagtattgctttcgcggccaggtcattgcaaattccctcccgctgcttttgcgttcgattgcattgtcattgcaagagttccatgtcttgacctgtgtgattgccgagtaggtcgtctttttgattgacgaaagagtgaaagcaatttagcttttagtcattcgcgaacgagcgatgcgaaccgagccggcccggacgagggccgctcgtcgccttgatcggagccctcatgacgtccttgctcacacccgtgcgtggctggcaccggccgctggtggtctgtgccgcgctcatgttcggcctggtgctcgtttccggcgtcgccaccgtcgtcgacggacggaccctgctggacgagtcggtgtgggtgaagccgctcaagttcggcttcgccttcggcctctacgcggccacgctggcctggctgctgacgaagctgaccaggggcaggcggctgggtcgccggctgggcaccgtcttcgcggtggccgccgccgtggaggtgggcgccatcaccgcccaagcggcccgcggcaccttcagtcacttcaacgcggaccagaccgacccgatcaccctggccctggtcccgctcctcacgttcggcgtgatggtcatcgtcatcgcgcagctggtcctcgcggtcgtcgtcctgatccagcgcaccggcggagcggcgctgaaccgcgccatccgcgccggcctcgcgctcgccaccttcggcatggtcgtaccggtcttctggatggtcaccgagatccactcccgtacggtgacggacgccaacggccactccgtacagatgtaccagggccacggcatcggcgaccccgacggccacgggatgcccctcaccaactggagcgtgaccggcggcgacttccgggttccgcacttcttcgcgctgcacggtatccaggtactcctcctgatcgccgcgctactggccgccctggccgccgagcgcgtctggctgcgcgacgagacggtacgggcccggctggtcggcagtgccgccctcggctacacggggctggtcgcggtggtgacctggcaggtctggcgcggacagtccctgatccatccggacaccgccaccctcctcgccctcgccgcggtggtgctgctcacgtgggggaccaccgcgcgagtgatcgtcaccgcccagcgcaccaccgcccagcgcaccacagtgccaccggccgggagtttcgtgccttcgcccccggcccgctgacaccacttccctgatccgacgcaccgaactcccgagaggaagaaccgacatgaccaggcagcccttctccaccgaggcaaccacgcggagcgcgccgacggccctcgcagcggccgtcacggccacccccgaccgctccgcgctgcagcaggtcctggaccgcgccaccgccccgggcggcgctcccggcgtcgtcgtcgacgtacgggacggccacggcgcgtggttcggctcggcaggcgtctccgacaccgggacccgggagaaacgccggccgtccgagcggttccggatcgggagcacgacgaaggcgttcaccgccacgctcgtcctgcagctggcggccgaaggccggctccgcctcgacgacacgatcgagcagtggctgcccgggatggtggtgggcaacggctacgacggccgggcgatcaccatccggcagttgctcaaccacaccagcggcatcttcaactacggcaacgacgcgcagttcttcacgaagggcatcggcgccgcgtggttccagcaccgttacgacacctacgcccccgagcagttgatcaggatcggtctggccacgccaccgtccttcgctccgggggaggccttcctgtactccaacaccaactacttcctggccgccctgatcgtcgagaagatcacgggcgggacgttcgccgaagcgctcacccagcgcatcgcccgccctctggggctgaccgggacctacctgcccggcacggaaccgacgatccaagggccgcacacccggcactactccaccctcttcgcctccgatgcacagcccgagatccacgacgcgaccgacatgaaccagtccttcgcgtgggcggccggcggcgtcatctcgaccacgggcgacctgcagcgcttcttcggcgcgctgctccaaggccacctgctgccggccggacagcagcaggagatgttcaccaccgtcgacaccacgggacccgtcccgtggatcccgggaacccgctacggcctgggcgtgttctcctgggcactgccgtccggcgtcacggtctggggcaacgccggcgcgacgtacggctcgtggacctgtgccatgggctcccgtgacggcaagcacctgctcaccggccaggtcaacggcgactggagcggcctgggcgtcctcgacgacatcctcaccgccgagttcggcgcggcggccggaggctgacatccgggagctgacgtccggaagctgacggcctgtggggcgctccaaaggccacggggttcccggtcacgtcgtggcgtcggccgggagttcgccggccaccggacgggcgtctccggcgatggggagggtgaggaccatcgtcaggcctccgccgggagtgtcctcggcggtgagggtgccgtccatggcctccaggaaacccctcgcgaccgccagtccaaggccgaccccggtgcctgcgggggcgtctccgtgccgctggaaggcttcgaatatccggtccttggcctcgtcggggacacccggtccgcggtcgacgacgcgtagttccaggcggtcggcgagggcgctggcggataccttgacgggccggccggcggggttgtacttgacggcgttctcgacgatgttcgcgacggaccgttccaggaggccgcggtcgacggcgaccatgggcagcgtctcggggatgtcgaggtccacgccgtcctcggggaccccggccagggccatcgggacgacctcgtcgagatcggtcacgcggatgagcgggacgacggtgcccgtctggaggcgggacatgtcgaggaggttgccgatcaggtggtcgaggcggtcggctccgtcctcgatgccttccaggagatcgccccggtcctcctccgaccattccacgtccgtggaacgcagcgaggtgacggcgaccttgatgcccgcgagcggggtccgcaggtcgtggctgacggcggcgaggagcgcggtccggatctgatggccctcgatcaggcggcgggcctcctcggcctcgcagaccaggcgctggcggtcgagtacgacggcggcctgggcggcgaaggcgccgagtacgcgccggtcctcggcgggcagtacccgcccggacagggccagggccatgttctcgccgatcggcatgtccacgtcggcgtcctcggggcgggggaccgggttccggccggtgctgcccgccgtggtccacggatccacgtccgtaccccgttccagcagcgcgacggactccatggcgaaggtctcgcgcacccgttccagcagggcgtcgagggcggtctcgccgcgcaggatgctgccggccaggaaggagaggatctcggattcggcgcgcagccgggcggcttgatgcgttcggcgggcggccaggtcgaccacggatgccacggacacggccacgccgacgaagatcgcgatggcgacgatgttcctggggtcggcgatggtgagctcgtggaccggcggggtgaagcagtagttcaggagcagcgacccgaaggccgccgaggcgagcgcggggagcagcccgccgaggagtgccgcccccaccgtgaaggtgaggaacagcagcatgtcgttggcgagtccgagctcggggacgacccggctcaacagcaccgtgagcagggcggggccgacgaggccggtgagccagccccagagcaggcggggtctgccgagccgcgcgccctgggggacgggcaggccgcggcggcccttggcggcctcgtcgtgggtgacgatgtggacgtcgaggtcgggtccggattcgcgggcgacggtggcgctgacgccggggctgaagacggactgccaggagcggcggcggctgacgccgaggacgatctgggtggcgttgaccccgcgggcgaactccagcagggcgtcggggacactgtcgcctatgacgtggtggaaggtgccgccgaggtcttccaccagggtgcgctggacggcgagttccttgggcgaggcggcggtcagcccgtcgctgcgggcgatgtagacggcgaggacttcgccgcccgagcccttctccgccaggcgggcggcccgccggatgagggtacgtccctccggaccgccggtgatgcccacgacgatgcgttcgcgggcctgccaggtggtgcggatgtcgtgctcgccgcggtactcgcgaaggtattcgtcgacccggtcggccacccagagcagcgcgagctcgcgcagcgcggtgaggtttccgggccggaagtagttcgagagggcggcgtcgaccttgtcgggctggtagatgtttccgtgggccatgcggcggcgcagtgcctggggcgacatgtcgacgagctcgatctggtcggcgcgccgcacgacttcgtcggggacggtctcccgctgccgcaccccggtgatcgtttcgacgacgtcgccgagggattccaggtgctggatgttgacggtcgagacgacgtcgatgccggcccggaggagttcctcgacgtcctgccagcgcttggtgttgcgcgagccgggcacgttggagtgggccagttcgtccacgagcgccacggcggggcggcgggcgaggaccgcgtccacgtccatctcggtgaaggtggttccccggtacttcagttcccgccgcgcgatctgttccaggccgtgcagcatcacctcggtgcgcggtcggtcgtggtgctccacgaaggcgacgacgacatcggtgccgcgttccacccggcggtggccctcggaaagcatcgcgtacgtcttgccgacgccgggggccgagcccagatggatacgaaatgtgccgcgtcccatgacgtcatccctcgaagcggtagcccatgccgggctcggtgatcagatacctggggtgcgaggggtccgcctccagtttgcggcgcagctgagccatgtagacccgcaggtagttggtgttgtcggagtacgtcggtccccagacgtcgagcagcagcctctgctggctcatcagcctgccgggatgggtgatgaggatctccaggaggtgccactcggtgggggtcagccgaacactgcgatcgtttcggacgaccttcttcgcgaccaggtcgacggtgaagtcctcggtcgtgaccgtggcgatctcgtcggcgggcgccggggcctcccggcggcggacggcggcgcgcagccgggcgaggagttcctccatgctgaacggcttggtgacgtagtcgtcggcccccgcgtccagggcccggatcttgtcctcggacgtgtgacgtgcggagaggacgaggacgggcacgccgctggtctcccgtacccccttgatcacgtcgatgccgtccatgtccgggaggccgaggtccagcaggatgacgctcggcttgcgcgcggccgccagcctcagagcggtgtgtccgtcggaagccgtctccacctcgaactcccgcgcctccaggttgatcttgagcgcgcggacgagccgggcgtcgtcttccaccaccagcaccttgatcatcggcgtggtgccttcctctcccagtgggcagcggtcggagccggcgggacgctgggtttccccacccggccgtagccgggagagatgagcgtcccgccggctccagaccttcgatgtgcggaatgtgcggaatatacggagtgtcagctcttggtcagtgccttgagcgcggtgttgagttcgaggacgttgacgcgcggttcgcccatgaagccgagggtgcggccggtggtgtggtcggcgacgagcttctcgacctgctcgacgtcgagcccgttctgctcggcgacgcggtcgacctggatcctcgcgtactccggggagatgtccgggtcgaggccggagccggaggaggtgacggcgtcggccggcacgtcctcgggcctgacctggtggcccgcggtggagttgtcggcgatgacggcctccttggcggcgatcacctgggcgcagagggttccctcctcggcgtccttggtgcactggccgttgacggcgccgttgtcggcggagcggttggtggcgccggagaggaccagcgagtactgggtgttgacgctgttggagccgaggccgttggaggggcgcggctggaaccacttgaggtcgggcctggcggcttcctccgggtcgtcggggttctgcttgggccggttgtaggtctgtccgatgagggaggagccgacgacccggccgctcttgtccttgatctcggagccgttggccttgtcgttgaagagggcctgggcgatccccgtgacggcgagcgggtagagcacgccgcagatcaccgtcagaaccagcagggcccgcagacccgcgccgatcaggcgcgctgtgttgctcagagagttgttcatggcggatcagcacgttcctaactcaggcgagcccggggatgagggagatgagcatgtcgatgatcttgatgccgatgaacggggcgatcaggccgccgagtccgtagatcccgaggttccggcggagcatcttgtcggcgctggtcggccggtactggacgcccttgagggcgagcgggaccagcgcgatgatgatcagcgcgttgaagacgacggccgagaggatcgcggagttcggcgaggacaggcccatgatgttgagcttgtcgaggcccgggtagaccacggcgaacatggccgggatgatcgcgaagtacttcgccacgtcgttggcgatggagaacgtggtgagggcgccacgcgtgatcagcagctgcttgccgatctccacgatctcgatgagcttggtggggttggagtccaggtccaccatgttcccggcctccttggcggccgaggtgcccgtgttcatcgccacgccgacgtcggcctgtgcgagggccggggcgtcgttcgtaccgtcgcccgtcatcgcgacgagcttgccgcccgcctgctcccgcttgatgagggccatcttgtcctcgggggtggcctcggcgaggaagtcgtcgacacccgcctcctgcgcgatcgccttggcggtcagcgggttgtcacccgtgatcatgacggtcttgatgcccatgcggcgcagttcgtcgaaccgctcgcgcatgccgtccttgacgacgtccttgaggtggatgacgccgaggacgcgggcgccgttctcgtcctccaccgccaccaggagcggggtgccgccggcctcggagatgcggttggcgaggaggtcggcgtcgtcggagacccggccgccccgctccttcacccaggtgatgaccgaaccggccgcgcccttgcgggtcttgcggccgtccacgtccacacccgacatacgggtctgggcggtgaacgcgatccactcggcctggccgagctcgccctggtggcgttcgcgcaggccgtacttctccttcgcgaggaccacgatcgagcggccctcgggggtctcgtcggcgagggacgagagctgtgcggcgtcggcgagttcggcctctgtcgttcccctgacggggacgaactccgatgcctggcggttgccgagggtgatggtgccggtcttgtcgagcaggagcgtggacacgtcgccggcggcctccacggcccggccggacatcgccaggacgttgcgctgcacgaggcggtccatgccggcgataccgatcgcggagaggagcgcgccgatggtggtggggatcaggcagaccagcagtgcggtgaggacgatcatcgactgcttggcgtccgcgtagatcgcgaacggctgcagggtcacgacggccagcaggaagacgatggtgagggacgcgagaaggatgttcagcgcgatctcgttgggcgtcttctgccgggccgcgccctcgacgagcgcgatcatgcggtcgatgaaggtctcgcccggcttggtcgtgatcttgatgacgatccggtcggagagcaccttggtgccgccggtgaccgcactgcggtcgccgcccgactcgcggatgaccggggcggactcgccggtgatggcggattcgtccacggacgcgaccccttcgacgacgtcaccgtcgccggggatgatgtcgccggcctcgcagaccaccaggtcgccgatcctgagatcggtaccggggacctgctcctcgcgcgtgccgtcccgggccaggcggcgggcgacggagtcggtcttggccttgcgcagggtgtcggcctgggccttgccgcggccctcggccacggcctccgcgaggttggcgaagatcgtggtcagccacagccaggcggtgatcgcccagccgaaccagttcgtcggatccgcgatcgccaggacggtcgtgacgaccgagccgatcaggacgacgaacatgaccggggacttgatcatgatccgggggtcgagcttgcggaccgcgtccgggaacgacttcagcagtgccgtggggtcgaacagccccccaccgacgcggccggcgggcggcttgtggccggtcggcaggtcgtcgtgcggagcacgggtcggtgtggcggtgctcatgatgcgagcccttcggcgagcggacccagcgccagggccgggaagtaggtcagaccggtgatgatgaggatggtgccgacgagcaggcccgcgtagagcggcttgtcggtgcggagggtgcccgcggtctcggggacgggcttctgctcggcgagcgagccggccagagccagaacgaacaccatgggcaggaagcggccgagcagcatggcgatgccgatggtgctgttgaaccactgcgtgtcggcgttcaggccggcgaaggcggagccgttgttgttggcacccgaggtgtaggcgtagaggatctcggagaagccgtgcgcgccggagttcgtcatggagtcacccggggtgggcagggccatggcggccgcggtgaagcagagcaccagggcgggggtgatgaggatgtagcaggcggcgagcttgatctcgcgggtgctgatcttcttgccgaggtactcgggggtgcggccgaccatgaggccggcgatgaacaccgcgatgatcgccatgatcagcatgccgtagaggccggagccgacaccgccgggcgcgatctcgccgagctgcatgcccagcagctggatgccgcccccgagaccggtgtaggaggagtggaaggagttgaccgcgcccgtcgaggtgagcgtcgtcgcgaccgagaagatcgcggaggcagcgacgccgaagcgggtctccttgccctccatcgccccgcccgtgacctcgaaggccgggccgtggtgggcgaactcggtccacatcatcagagcggtgaagccgacccagatgacgcccatggtggcgagaatcgcgtagccctggcgcaggttgccgaccaagcggccgaacgtacgggtcatcgcgaaggggatgaccaggatcaggaagacctcgaacaggttggagaagggggtggggttctcgaaggggtgggccgagttggcgttgaagtagccgcccccgttcgtgcccagctccttgatgacctcctgcgaggccaccgcgccgccgttccactgctgcgtgccacccaggaactgcccgacctcgtggatgccggcgaagttctggatggcgccgcaggcgacgaggaccagtgcgcccacgacggagatcggcagcaggatgcggacggtgccgcgcaccaggtccgcccagaagttgccgagttcgccggtgcgggagcgcgcgaagccccgtacgagggccacggcgacggccatgccgacagcggcggagacgaagttctggaccgcgaggccgccggtctgcacgacgtggcccatggcctgctcgccggagtacgactgccagttggtgttcgccacgaacgacgcggcggtgttgaatgcctggtccgggtcgatcgaggagaagccgagcgaaccgggcaggatgccctgcacgcgctgcatcaggtagaggaagaggacgctgacggcggagaaggcgaggacggcacgcagataggcgggccagcgcatttcggccgacgggttggcgccgatggccttgtagatccacttctccggcttgtggtgcttctcggaggagtagacccgggccatgtagtcgcccaggggacggtacgccagagccagcgcggcgatcagcgcgagcagctggagcacaccagcggttacggggctcatagcagtgctcagaacctctccgggtacacaagggcgaggacgaggtaaccgagcagggagacggccacgacgaggccgacgacgttttcgaccgtcacagcttggtcaccccccgggcgatgagagccaccagcgcgaacaccgcgaccgtggtgacgacgaaggccagatcggccatcgcgagctcctgagtgaagtggaagaaatgaatcagccagatggccgatgacgagacaaccgcgtctccacccgggtgttaagacactttgacggggtccatacgagggcgcgggaagccttaacgccaccctgacggtgcaggccgcccgcagggcatcagacctggtgaggcaggcccgccgtgtccagggcggtcccggcctgcgcggccagcgcgcccggccgcccgcgtacccagggcggcgaccgcgaccaccacgacgaccatgatcagcgcctcgttcgtcgccgaaagatccgtacggaagggcacgagcgccagcgcggcgacgaaggggggcacgagggccgcgacgcctgcgaggggggcgcggagccggaaccagtagccggacacgtgaggcctcccgtccggacgagccgttcgtggtcaagcctgccccgtcgcagcgccggcgcaccgcggggcgccgcctcttgacggaccgctgacgccggtcccacccgcacgtatggaatgcgtgaagaggggcgggccggacgtatggaatgcgccaagggcgctgttcgccgccccgcgcggctccgacgctgtcctcactttgctcattcggagggaccggcgacatggccgtacacgtaggaaaaccgaccgcgctcgcccaggaaccgggccttgaggagcccccggacgccagcgccaccggagccggggaccgccacaggctgaccgctctccaaggcctggccgcgctgtcgctcgacgcgatggcgtccgtggcgtacgggcccgagtcgatcgtgctggtcctggccgccgcgggcgcgtacggcatggggttcaccctcccggtcaccctcgccatcgccgcgctcctggccgtgctcgtggcctcgtaccggcaggtgatcgccgcgtttcccgacggcggcgggtcctacgccgtggccaagcggcacctgggccggcggaccagcctggtcgcggccgcgtcgctgatcctcgactacgtcctcaacgtggccgtctccgtcacggccggcgtggccgccctgacctcggccttcccgggcctgcacggtgagcgggtctggatctgcctcggggtcctggtcctggtcaccgcggtgaacctgcggggggtcgtcgattccgccaaggccttcctggtcccgaccgcgctcttcgtcgggtcgatcctggcgatgatcgccgtcggtctcttccgcgacggtccggtcagcaccgcctccgcggcggggcacgactccgccctcggggagggtgccaccgcggtcggggcactcctgctgctgaaggcgttcgccgccggctgctcggcgctgacgggcgtcgaggccgtcgccaacgccgtaccctccttccgcgccccggccgcccgccgcgcccagcgcaccgaggtcgcgctcggcgccctgctcggcgccatgctgatcggcctgtccgtcctcatcggccgattccacctccagccggtcgagggcgtcaccgtcctcgcccagctcgccgacgcctccttcgggcacaacgcggcgttctacgtcgtccagttcgccaccatggtgctgctggcgctcgccgcgaacacctccttcggcggtcttccggtgctgttgagcctgctggcccgggacaaccacctgccgcacgtgttcgccctcaaggccgaccggcaggtccaccgccacggcgtggtctggctggcgctcgtctccgccgccctgctcgtcttctccggcggggacaccaacaccctcgttccgctcttcgcgatcggcgtcttcgtcggcttcaccatctgccaggtcggcatggtccggcactggtacggcgagcgccccgggggccggcggaccaaggccgccctcaacggcttcggcgcgctgctgaccggcgtctgcgcggtggtcgtcaccgccaccaagttcaccgagggcgcctggctgatcgtcctcgccctgccgctgatcgtcctcgccttcgagaagattcaccgtgcctacgccgagatcggtgagcggctggagctgggccgcgtcccgcagccgccgaaccggtcccactcgctcgtcgtcgtccccgtctccggtctgtcccgcctgacctgccaggccctcaccgccgcccgctccctcggcgacgaggtcctcgccgtcaccgtcacccaccccacggcggaggaccggcgggcggccgaagccctgcgccgcgactgggagtcgtggaagccgggcgtcgagctgaccgaactctccccggagacgcgctcgctgggccgccccgtatcggcgtacgtccgcaggctcgcgcagacccacccggacgcccagatcaccgtcctcatcccggaaaccgaatccgcccgcctctggcagcggctgctccagaaccagcgcggttccgtcgtcgcccacgcggtccggcgcgacaccgacgccgtcatctgccgcctccgcttccgcatcatggcggaggccgagccgccggtccccgggacgggcgcgacgcactgaccacgccgaccccgccggccgagtccggctggacggggcgatggcggcgccggacgagcggccacccggagtccatcgggtgagtatcgccgctcatcccgccgccgccgggtttccgggtgcgagggaagtacgtccgctacgccacaggtggccctgtttgcgttaaggacgcgtcagggtttgctcgctcgcgtgcatgagtgatcagtctgcgtacgcttgctcagtcgtcggtgtcgatggctgattctttgcgtacgacaggagcaccccacgatggccacccctgcccgcacgtcacgcctgcgcgcgtggatgctggaaggcttgaccgccgagaacagttcgcccgccgccaaggaggcggcggcccagccccacggccggccgtggtggcgcgtcatgtgcctgacgggtctcgactacttctccaccctcggctaccagcccggcatcgccttcctcgcggccggtctgctgtcgccgctggcgaccatcgtgctcgtgctgctgaccctcttcggcgcgctgcccgtctaccggcgggtcgcggaggagagcccgcacggcgaaggctccatcgccatgctggagcggctgctgaccttctggaaggggaagctgttcgtcctgaccctgctcgggttcgcggcgaccgacttcctcatcacgatcaccctctccgcggcggacgcgaccgcgcacatggtcgagaacccgcacctcaccagcaccctgcacggccacgaagtagtgatcaccctgatcctgatcgcgcttctgggcggagtgttcctgaaggggttcagcgaggccatcggcgtcgccgtggtcctggtggccacctatctcagcctgaacgtcgtcgtcgtggccgtcgggctgtggaacgtgttcacgcagccgcaggtcatcaccgactggacgaccgcgctcaccgccgagcacggcaaccccttcatgatgatcgccatcgcactcgtcgtgttcccgaagctcgcgctcggcctgtcgggcttcgagaccggcgtggccgtcatgcctcacgtcaagggcgatccggacgacaccgatgcgaagcccgcgggccggatccgcggtgcgaagaagctgctgaccacagcggccgtgatcatgagcatcttcctgatctgctccagcctgatcacgaccctgctgatcccggccgcccagttcgagccgggcggcgaagccaacggccgcgccctcgcctacctcgcccacgagtacctcggctccgccttcggcacggtctacgacatctccacgatcctgatcctctggttcgcgggcgcctccgcgatggcgggcctgctgaacctgatgccgcgctatctgccccggtacggcatggccccgcactgggcccgcgccctgcgccccatggtcatcgtgttcaccctggtcgcgttcctggtgacctggatcttcaacgccgacgtggacgcgcagggcggcgcgtacgccaccggtgtcctcgttctcatcacctcggcggcggtcgccgtgaccatcgccgcccgccgggcgggggagcgcggctggaccatcggcttcggcatcatctccgccgtcttcatctacacgaccgccatcaacatcgtggaacgccccgacggcgtgaagatcggcgcctgcttcatcgccggcatcatggccctctccctcctctcccgtctggcccgcgtcttcgagctgcgcgtcacgcacgtggagttcgacgacatggcccagcggttcatccgcgacaccgccaaccgcacgatccgtttcatcgcgaacgagcccgacaaccgggaccgcgaggagtaccggcagaagaaggaacagatccgcgcggacaacgacatccccgccggggacgacgtgatgttcgtcgaggtcaccgtcctggacgcgtccgagttcgagtccggcatgcgcgtacgcggcgaagtactgcacgaccgctaccgcgtcctgaccctggagagctccagcatccccaacgccctggccgcgctcctgctccacgtacgcgatgagaccggccagcgcccgcacatctacttcgagtggaccgagggcaacccgatggccaacttcctccgcttcttcctcttcggccagggcgaggtcgcccccgtcacccgcgaggtcatccgggaagccgaaccggaccggtcccgccgcccccacgtccacgccggctgagccgcccggcggcctagctgccgatgtcccggctgcggaagtcctccagcgtctcgcgccggaccagcacccgcgacgtgccctcgtggacggcgaccaccgggggacgccccaccatgttgtaaccggacgccatggacagctggtacgcgcccgccacgggtacggcgatcaggtcaccggggtggacgtcgcccggcagctccacatcggccgcgagaacgtccccggcctcgcagtgccggccgacgaccgtggccgtgcaggcgtcggcggtggagtgccgaccgatcaggcggggcgcgtagcgcaccccgtacagggcgggccgcggattgtcgctcatcccgccgtccacggcgacgaacaccttctcgccggtgtgcttgaccgcgagcacgcggtacagggcgaccccggccggcccggcgaccgcacgccccggttcgacgaggagccggggcacggccaggcccgcggcggcgcagccttcgccgagctcggtgcgcaggccgcgggcgagggcggtgaggtcgagggcggactcgccgggccggtaggcgatgccgtggccgccgcccatgtccagctcgggcaggtcgatgccgtgcgtgtcgcggatgagggccatcagcccgaccatgcggcgcagggcgacgaggtacggctccacctcggtgatctgggagccgatgtggcagtgcaggccggtcagttcgagctgaggctgtccgagtatgcgcgcgatggcgtcctgcgccgagccgtcggtgagtgagaggccgaacttctggtcctccgtaccggtacggatcttctcgtggcccccggccgagacgcccggcaccacccgcaccatcaccttctggtgcccctccggcccgacggcggccgcgatccgggcgatctcggacggcccgtcgatgacgatccgccccacgccgagccgcagcgccgcctccaggtcgcggggcgacttggcgttgccgtgcagcacgatccgctcgggcgggaacccggcggtgacggcgagctccagctccccggcggagcagacgtccaggcccagtccttcctcctccacccagcgcacgatcgcgcgggagaggaaggccttggcggcgtacaggacgtcggcctcggggagggccgtgcggtaggtgcggcaccgctcgcggacctcaccctcgtccagaacgtaggccggagtgtcgaaccggtcggcgatctccgtgagggacaccccgccgacggccacgtcaccgtgcggaagcagggtcgcggaggcgggccacacggacagttcaccggcacgggccggaacctcggggagggaggcgatggacatggtgcggttcccttcagacggtccgggcaatggtcccgggagcctgcgggaccggagtggtgaccgcccccgtagccgccgcggtggccgtccccgtcaccgcaggtgcggtgagggccgggtcgacggtcagcagcgatgctccgaccggttcggtcatcgcgcggagcgcggactcggagagccggatccaccgctggcctgcgccgagcgtcgcggccagccgttcggcactggtgaagcccacggcggtacgcgcgcccagcggggtgcggaacaggcgtaccaccacctccgcccttcccggcaggaccggtacgtacaggggcccggccgggacgcgttcttcaggctccgggtcgtcttcgtactggaacaaacacatgaggccctcccagaggaaccacgagtgacggttgaggccccggacgcggggaggcggtccagggcacgacgacgaagctatccccgcccgcacgcacgtgcggccaccccatgacgggacctttacggcggcgggtcaagtccatacggatcgctgacggccccccgaccggggcggcatcagggttccgtatcggctgtggacatccgcgtgagaggagagggaagaggccgtacgaaaagtcgtgatcggtgctacgggcaccccggggagcccggccgtcttgcacaaggccgccgcggcggcccttgtgcgtgatgcggagctgtgggtcgtcctggcctggcagccgccgggcggcgagctcgggatcccgcgcggtgtggcgccgcctcgtccgcccatgccttcgtgaccagcgaaatcgacccgggagggcggtcaccccggacggctgcgaggacatctctgccgagtcggaggagcatctattgctgtggggccataacggcgcgccacgccccggcgggcacgaggcggcgcacatcggtcggccgcgaggaggaaggccatgatcgtcgactgcgcacattaccgcgatgggcgtcgacaggacgagggcgccatgcctctggagcaggcggccgcgcgctgccggcaaggcggattcgtctggctgggcgtcttcgaaccgtctcccggggaactggaccgggtccgcgagatcttcggactgcacgagctcgccgtcgaggacgccgcagccttccacctgcggccgaaggccgagcagtacgaggacggcacagaactgatcatcctgcgcacggcccgctacgacgacgagcgcgaggagatcgacaccggcgagatcagcgtcttcctcgccgaccacttcgtgatcaccgtccgccagggcatcgcgagcgagctccacgaagcccgcagccgactggagagccgccccgaactgctcaagaccggcagctcctccacgctgtgggcgatcctcgaccaggtcgtcgacagctacgcgccggtcgtcggcgagctcgagcgcgacatcgagcagatcgaggccacggtgttctccggggccgtcgccccgaccgaacggatctactccctgcgccgcgaggccaccgacttctaccgggccgtacacccgctgctcgccgtcctcaccaggagactgcagcccggcaggacgccgcccgcgctccagccgtacatgcgtgacgtgcacgatcacctgctgctcgtcaacgaggaggtcgccgcccagcgcgacctcctgaccaccgtcctggaagcgaacatcgcggtgatctccgtggagcagaacaagatcaaccttcggcagagcgccacgatggaacggctcacgatcctcgcgagcgtattcctcccgctgtccttcgtggtcggcttcttcgggcagaacttcgcctggctggtcacccacatcagcagcttcacggcgttcctcaccctcaccctcctcggggtgctccttccgtgcctgctgctgtacgtctggctccgccggcgccggaaccggccgacaccgccgttgccggaagcgagccccgtcggccggaacgccccggcatcctccgcgcagtgaatcccgcgcgatcggccgagacggatggtcggggcgatgatgccgcgggtgacgacctgtgagccgacccggctcagcgacaggtcgacggtacgatccgccgcactcacggccatccggaccacgccgccacgcagtccggctcgtgaaacgaaggccgagcccgggggaggggagccggcccgtgccgctcatgctgccgggtaccctccgaccgcccggcggtaggccatgtgcccgccaagggcgccggtgacggcgacggcggccagcccgccgagggaccagagccggcccttcgccgggcggccgcgcaaccgcgacgtcagggacacggcgtaacaggccaccgcggccgcgttcgaggccgcgtgggccaggccgacccgggcctgttcgggaggcaggtccgcccagtccacccagccggccaccgctgccggggcgatcccggccagtccgacggcggtgagggtcgtgctcgcccgctgcgtaccgggtacgacgtccagcacggcggacgagagccagcatccgatcggcacctgcaccagtacgggatgcagggggtgcccgagcggcctgccgcgcagcagatcacgcagtccgcccagggggagcgcgcggatgccccgctggagcactctgatcgccggatcggccgccgaggtccgttcgagccggtccagtgcggtcagccaccgggtcgaggcggtgtcgagtactgcggtccgcccggtcacggccgaggcgtcgggggtgtgtgcgttcatactcgacgcctacccggtcccacaccgcgatcccgccccggaccccactggcacccgaacgaccagcctcccgacagggcagtcggccgtcggagcgccggacccggcgcgggcgtcgccgcgctgcccgatcggatcgtcgcggtggaccatcctcgttccggacgaaggcggacgtcaccaccttgtgtggtcgtggcgccacatcgtgtcgcaccgcgaggcgttctaccatgaaacacacagtcttcttcattcccgcacctgctcacggcgagacggtagggaggccggcatggagttcggcaccggatccgggggagtggacggtgcacgctatctgccgatttccgagcacggcctgatcggtgatctccgcaccgccgcgctcgtcgggaccgacggaacgatcgactggtactgctgcccgcgcttcgacgcaccgagtgtcttcgcgtccatcctcgacgccgacaaaggcggatcgtgggagctggccgccgaggtgccggcgcgtacccggcagttctacttccccgacaccaacgtcctgatcacacggttctacgcggccgacggggtggcggagatccaggacttcatgccggtcgtcgacgagtcgcgcgaggcgtcacggcaccggctgatccgccgggtgatatgcgtgcggggcaccctccccttcaggacacgggtggccccgcgcttcggctacggcgccgaagcgcacaccgtacgcacgcaggtccacgaagccgtcttcgaggccccgtcgatctcactcgcgctgacctccaccgtgccgctcgaaagcgacgggaccgacgtggggtcgcacttcaagctcctcgaaggcgagtccgtcgtcttcgccctcgacaagatcagcgatgacgtccgcccgcaggcctgtccgcacgccgaggcggaggagcagttcgaggcgacggtccggttctggcgccactggctgggccgctcgcgctatcgcggccggtggcgggagatggtgcaccgctccgcgttgctgctcaagctgctcacctatgtgccgaccggtgcgatcgtggccgcaccgacgaccagcctgcccgaacgggtcggcggtgagcgcaactgggactaccggtacgtgtgggtccgcgacgcggccttcgccatctacgccatgctccgcctgggcttcacgacggaggccgaggcgttcatgggcttcctctccgaccggggcatcatgcggggcgtcggccccaccggtccactgcagatcatgtacggcatcgacgggcgcaccgaactgcccgaatccgagctgctccacctcgaagggcacctgggatccgctccggtgcgggtcgggaacgccgccaccaagcagctccagttggacatctacggcgcgctgatcgattcggtctacctctacgacaagtgggggcagcccatcagcagtgatcactgggacgaggtcggcgcggtggtggactggctctgcgaccactgggaccagcccgacgagggcgtctgggagacccggggcggccggcggaacttcgtctactcgcggctgatgtgctgggtggcgatcgaacgggccatccggatggccaaccggcggggcctgcccgccgatcttccgcgctggcagcggagccgggacgcgatctaccggcagatcatgcgcgacggctggtcggcgaagcgcggcgcgttcgtccaagggctgggggacgacgtactcgacgcgtccgtgctgatgatgccgatggccaagttcatctcgcccaccgacccgaagtggctctcgaccctggatgcgctcaccacggatctggtctccgactcgctggtctaccgctacgacccggaggccagcccggacggcctgcgcggcgccgagggcacgttctcgatctgctccttctggtacgtcgaggcgctcacgcgtgccggacgcctggaggatgcccgcctggccttcgagaagatgctcacctacggcaaccacctcggcctctacgcggaggagatcggccggagcggcgaacaactaggcaacttcccgcaggcgttcacccacctctcgctcatcagcgccgccttcaacctcgaccgcgccctcggctgagtcccgggccggcgcctacggagccgtgccgcaggtacgggccggacgcaggctcacgatgctcgcctgcggcacggagagcccggtgaggcggcgcgaccggacgaaaggcaaacgctgtgggcacgtcccgagcaggatggctgcacctgacccggtgtggctacgaagccttgggccaggggaacctccccgcccagtgggcccaggccaccagcaccatcaggacggctgccagtccgcccagcaccatgaccgtcgagggcgaggagtggtcgaggacggcccctccgaccagggctccgatggagatggtggcctggaaggaggcggtgaagaggacggaggacgcctcgggggagtcgggcgaagccttggcgaaccaggtctgcgagcagaccggcacggctccgtaggcgacgccccagacgatcagcagtgccaccgctcccacgtccgaccggccgaggaccgggaggagcagggtcgcaccggcgatcaacgcggcggccgcggcgaaggtcgcccgcgggtagcgccccaccgctgatccgccgaggaagttgccggcgattccggctgctccgtagacgagcagatagaccgtgatgagggccgagctcacctgggtcacctgctccaggaagggggtgacgtacgtgtacgtgccgaagtgagcgagcacgacgaggaaggtcatcaccagggcgaagcgggtgttgacgctccggagcatgccgccgaggacgtcgaggcgcgtcgtctggtcggaggggagcggcgggacgaccaggagcagcagggcgaggacggccagcgtgaagccgcccatgacgaggaacgccgtccgccagcccgcgatgtcaccgatgagggtgcccagcggtaccccgagtacggagccgagcggtaccgcggagaagatcaccgaggtcgcgcggcctacggattcggcaggcaccaactggcgggcgagcccggctccgatcgaccagaagccgccgatggtgacccccaccatgacgcgggagaccaggaccagccagtagtccggcgctgtggcggccaggaaattggccagcgccagcacgaggatgaacacccccagcatgacccgccggtcgatacgccccgtggccaccgtgaccaagggggctgaaaccgcggccaggaatcctggcatggtcatcgtgagaccggccattccgtccgagacggtgaaactcgatccgatcgaggtcagcaggccgatcggcagaatctcagcggtgacgatcgaaaagatccccagcatcaccgcaatcacagccagccaggaagccgaagccgagcgatccggcggtgcgggagattgggcagaagcggtggttgttgcagacatgaatcccgtcctgagccgcggacatcacatgcagagtgcgaccaccagtccagcaggaacgggcaccatcctctggcggattcccgacaccaacgatcagccccaaaccagtgtcaggggtgtacgaggcggggaagaacgcaaaggtggagctcatttctcccaagagggctgccgctgccagagcggcgacaggaaaccttcccctcacggccagctgacgcgtccccggggagcgcgcccgtcacctgcttcgccgcgttcggcacggatccgactgcgcgtacgcatcaggatccggccgagcatgttctttccggtccccgtccggccgcgtccccagtagtgatcggacgtcgtgtcctcgacgatctctgcgtctcccgtggcgagcaggatcgcgccgatgtcggtgtgcgtacggaacttggccgccacggcgcggcgcatcacgtcgtccttcacccgttcccagtcccgccgcatcggcttcgacgggtcgcggcccagctccgcggcgcgcagcggggtgccggcccggcggatgagctcggcgtggcgggtgccggtgaacttctgtgcctggaaatagtgttccgtggtcggccaccagtatccgtcgaggtccacgccatgtgcggagaagttggagaagcagccgtagggaacttcctcggcgccatagaagtagatcggcatacgaacctcgtggcaggggcgggaaccgcaccgtgtcaggagccggcctgcggtcgcaaccgacttaccgcccggcccaccacgctggtgcggccgatccgtgatatccggaaccgcacgtccagccccgccgtgtcctgaatcggctccgtgtgcgtcatgagaaaatggcgcacgacgagaggggcgtcgcgataccgtgagcgatcaggatccaggctccatccctgttcctgccaagaggccgtgatggctcgttcggcgaagagtgcacagcgcgagtcgtggaccattcccagtctggaccggttgggttcgtcctgcttcggcgggcagcctgcatgacctgttctccccctgctgcctcgtcctccggatccgggacgattcgatgccctgccgcaggtggcgacggctgccgagcgctccgcatgccggatcgatcaccggctaatgtgaccgccatgcattcgatcgagtttcgtgtggctccccaatccggcgggggtcagggccggggcgagacgccctctgcggtggaattcctggtggatgggattccgttcctggaactggtacgcagggcggagcttcccgacgcgttcgcagaacagcaggagcgagccgccgagttcgcgcccgaccctgttccgctgctcgcaggcgcgtacgcatatccggcgctcctgtccgcccggaacctgctcggcggcgaacccgaccgtgtgccgcacggcgcagagcggggagaaacgctgctgttgtcgtgcacgtgcggaattgacgactgctgggcgctgacggcgcacatcacggtcacggacaccaccgtgacgtggtcgggcttccgcaacaattcccgggactggaaccacgactccctcggcatcctggccttttcccgccctcagtacgagcagtcgctccgcgctgccctcgacgccctgtcggcactccggtcctgacgcgcatccactgatgctcacggcgctcacggcgcagccgccgacgacacaccacacggaggggtatcccatggagaacgagccgatacaggcctgcctggacctgctggagcaggcgcgccacctgtcgctggaggacgagcggcgccgcctgctggaacaggccgccagtgacctcgtccgggacgggcggcgtcgtcggcgtgccgcgagacgagccgtccgggccgccaccgacgccgagttgctggccgacacggtgacccgagcgcccgaccggatcatggatacggcactgtcggccgacacccggcaccgggcgggcctgtccgtgcacgagtacgtccaagggcacagcggtccacgcggagtgacccgccggacgccgggtcgcgtaccggacggcgacgagccacccagactgctcaaccgtccgcaacgctgctacgtctgcaagaaccactaccggctggtccaccacttctacggccagctgtgcccgggctgcgccgacgagaacctcgcccggcgcaccgcccggaccgatctcaccggccggcgggcgctgctgaccggtgggcgggtcaagatcggcttccatgtggccctcatgctgttgcgtgacggagcggaactcaccgtcacgacccgcttcccgcaggacgcggcgaaccgcttcgccgcggcgccgggtgcggccgactggtggcaccgactgcggatagccgcgctggacctgcgcgacccgagacaggtactcgccctcaccgaccacctgctcgacgaggccgcacctctggacatcctggtcaacaacgcggcccagacactgcaccggtctccccgggcgtaccgtgcgctggcagcggctgaggccgccgccgtcgcgacggcccagcgcgccaccgcgccggagatctggaccgcccccggattcgccgttcccggatcacataccgcggcactccctctgacggcagaactcgcctcacgcgcccgggtctccggcgccctggccggcgtccgccgcggggccgaaggagccctcgcgccgaccacggagccgaccacggagccgaccacggaaccggccccgactccggccccggcctcggatctgcaggagcgcaccgacgaggcagggctcctgcaggagacgggctccagcaactcctggaccctgcggctcggccaggtcgaaccggccgagctcctcgaagtccagctggtcaacgccgtggcgccgttcctgctcgccgaccgcctgctgcccctgctggaggcgtccccgcatgcccgccgctacctgatcaatgtctcggccgtcgagggccagttcgatgtccgcaacaagaccagcggccacccgcacacgaacatggccaaggccgcactgaacatgctcacccgcaccagtgcggcggacctggcggcccggggtatccacacctgcagcgtggacacgggctgggtcaccgacgagaagccgctgcccgcccgggagcggcatgccgccaccgggtggcgtccgcccctggacgtcatcgacggcgctgcgcgcatctaccaccccatcgtccagggacaggcaggcagccccatccacggcgtgctgctcaaggactaccgggacgttgcctggtgacctgcccgggggcggcggcgaaccgccgcctgaacggcggcagactccgggcccctatgctgaaccgatggacgagacctccgcggctcaggcggccgcctgctggccgctggtcgcgtccgccgagaccgacgggctgcgggaactggccggcgacgacgggctcaccgggttcatgcccccggcgatgcccgacgcggcctgggtgctccactccatgtacgagcacgaactcgggcccttcgacatgccgtacgtcgagtaccggcgggcgttcctgaacagcaagagcggcggcctggagatcatcccgggcctcgaccccgcggaggtgttcaccgacctcccggacaccttcgcgccgtccagaggcgagcacccggggccgcgctggcgccgtctacgctgggcggagctcgcccgccggaccggagatcccgtggccgccgagggccgcctgccctgctacacgtccttcgcctcgctccgcgatcggggcggctggccgctcggcatcaccggcccgtccgagggcaccctggcccgtgcggactggaaccggctgatcgggatcctcaccgagtggagccctcagggcgcggacaccccctgtctcgcctactacacgccactgggccagggagccgaggacttcgaccacctgcacgtgcgggccggccgtctcggggacgccaaggccctgtacgaccaccccgacgaagagtggtggactccgtccaacttctgggcccatgaccggtcctggatcctgtgcacggactacgacttgtgggccaccaagctcgccggcccggccccactcgtcgaagccctcctcggcgacccggagaccgaggccgtacgactgccctgggcccactgattccgccgaccggcccaggaaagcgcggtgcggtgtccaggcctggccgttggcctgtacgcgtcggagctgggggcatcgctctggacttcgggtcaatacttcgtaaagtcaggtacggcgcgggggagccgcgcacagaacgatgggggagtcagtgcttctgaaaaccttcggctggtcgttcgcggtgaccgccctcggtctggtcgcagcgttgttatatgggggttggaccggattcgggatcgtggcgatcctgtccattctcgagatttcggtgtccttcgacaatgcggtggtcaacgccgggatcctgaagaagatgaatgccttctggcagaagatcttcctcaccgtcggcgtactcatcgcggtcttcggcatgcggctggtcttccccgtcgtgatcgtcgcgatcagcgccaagatcgggcccatcgaggccgtcgacctggccctctccgacaaggagatgtacgagcagctggtgacggacgcccacccgtccatcgccgccttcggtggcatgttcctcctgatgatcttcctcgacttcatcttcgaggaccgtgacgtcaagtggctcgcctggctggagcgcccgctcgccaagctcggcaaggtcgacatgctgtccgcctgcatcgcgctgatcgtcctggtcgtcgcctcgatgaccgtcggtgcccacgcccaccagcacggtggcgtccacgtggacaaggcgcagaccgtcctggtctccggcgtcctcggcctgatcacctacatgatcgtcggcggcctctccggctacttcgagaacaagctggaggaagaggaggaggccgagcacgaggccgaggaggaggccaagaagagcggcaagcccgtcacggccgtcgccatggccggcaaggcggccttcttcatgttcctctacctcgaagtcctcgacgcctccttctccttcgacggcgtcatcggcgccttcgccatcaccaacgacatcgtgctgatggccctcggcctcggcatcggtgccatgtacgtccgttcgctgacggtctacctggtccgccagggcaccctcgacgactacgtctacctggagcacggcgcgcactacgccatcggcgcgctcgccgtcatcctgctcgtcaccatccagtacgagatccacgaggtcatcacgggtctcgtcggcgtcgtcctgatcgccgggtccttcttctcctcggtcgtgcgcaaccggaggctgggggcgtccgggggagagcgcacggggtcgcacgagaaggccgaggtctcctccggcgtctgagccggtccgggccaactcaccacgtccgtccactgggtgacggcaaggctctccgggcgacgaccggcgccctgcctgggcggtgaccgaggcggggcggtccggccgtcaggcagccgagtccgcggtgtcagtgctcgcagagggagaattcgcgttcgtagagctgctcgttgtgctcggcgacgaagaatttccgttcctgcatgagctgttcacgataggtcttcgcctgttcgagcgtcatggtcgacgtatcggaccagggctgctgcggtggcacatcggatgtcgagacgattctttccgacgggtcgaccaggaagaaggcgaggatcttgcggtaccccgggcgagcggtgtccgcgaggcggaacgagtcgacgcggtgctgcaggatgttcgggaacgccaggcagcggcccgccggggtcgacgcggatcccaggacctggttcagcgagtcttcgtcttccaggccgtagacctcacgcagaccgttgtcgtcgttctgctcgtagttcggatcgtcgagtgccgcccggaaacccagccggctttccgtgatgttctcgctgtcccagtagtagataccggtcgatacgatccgctcgttcatcatcccctcgacgtgccaggaaccgccggcgtactcgggcttctccggggtgagatgaagggtggcgagcttgacgatgacctggagacggcggccccgcaggtcgacccgggcggatgcgtcgggcgagtcgggcatggtgaaggccggggcgtccgggatgaccgggcgccggttctcccaccatgcgtcgtgggcctgctcccacacacccagggcctctcgataggcctcacggtcaccgtaggcggacttatcgggatactccggctccgagtcgtaccacccgtagggatcggcctcgatccgcaagggccgcggatggcgcagatccgtcagcacgttctccagcagcggccgcatgcgggcgaacaagtcctccaggacaggtaccagttcgcggtgggtctcggggtggacattgttgacgtacgaacagaaggcggcatcgccgtcgtcgctgatgtcgacgtccgtgggaagccactggaacttctccgagaactcgtacttcgaatagcggtcggtcgggttctgccaagcccgatcgtgcgcgccgctcgcctctctcaccaagcagaacagcgagggatggaccagatccagtacctgaccgtcggatccgggatgccagtcctgttctgcctcgggaacctgttccagcacccgaaccgcctcgcgcagccgtgatcggagcttgtcgtcgaccagagtgtccgactgccagaccccgtcgacggcggacacctcgacgccggttcgtccgtcccgtagggcggcgtaatgcgcgagttcggcaagcacgtaacgcacctgcgcttcggtgaggccctgggcgaccgcttcccgcgtccatcgggcgacgatgtcggcatcgttcatcttgtcgaaccatcccggcttggcccgaatgtgcgcgctgcactgcatcatctggacctcccgcagtgttcggggcgtcgcgaacgacagggaacgggatgcctgaaaaggcagcgggaaagcagacaggccggtcaattcttctggtcctccgagtcggtgtgcggtggccggaagactacttcagaggactgacaccgcagccgtcgtcccgtcatcgggggcccgggagcagcggaaggcctggtcggccatggtccggtttgcgtgttcagacgatcgacctgatggtcctgtccgcgtaccgcagcgtctcgtcgatggccgcgtccatctcgcgcagagcgtcgggctcagccgtgaggagagcgctgacgttgatgctgctcacggcgaggaggcagcccgccaccctgaggaaccccttgtaccgttcctgcccgtcctccccgagcgaagcccagtcccggggttccggcggcagaccggccctccacttctcaagggcgtgggtgccgtggacgctgacgtactccatgatgtccggggcacggagcagtacttcgatcatcgcgtcgaacccttgctgcgactgatccagcgccgcctccgcagcctcgacctcggttcgcagacgttcctcctccttcttgttccggcgccgcctcaagacgtagaacccggcggccgccagtgctgccgccggagccgcgaccatgccggtgagcaggagaatcccgccggccatgcccgcaccgccggcggccagcgtgcctcctcccaggagggccagcgtcgagatggccgttccggtggaggcggaaccgaacaacgcggccgcggtgaaagcgccgtaggccgcggcgccgccgactgccgccccggccgcacctccggcggtggccccccggatggcgttggcgatcccggcggacatggctccgatacgtatcgccgtagaggccctggccgcgctctcgatctcctcctggcgcggcctttccggctcgggcgccccgctgatgctcttggccagctccacgaacctcatgaagaactcgtcgcggacgacatcatggacgcggtaaaaggcttccccgtgctcttgggtgatcttcgaccgctgggccgccttctcgttgacctcggcgtagcgtcgcttcgtctccgcgacctgttcgcgcagcttcacgggccgctggccccgctgatgagcgagggacctggttcggtcctccgcctcctgcttgagttgctcgggcgtcagccggagggcgagggcgatggcggccagacggtgctctctggggctgatgagcccgtgctcgatccgggagatcgagaccgcgccacccttcccgtagtcggcccgcctggccaactcgtcctgggtcatcgagggactttggtccaggcggtactcgcggatcacgaggcccatcgcctctgcgctgaactcattcaccggtcccggccccggcgccttgggccggcggcctgtggcgacgccaggaggactgggcctcacgcgccaccgcagcactggagcggatcgcctggaggctgtcttcgatgaactgcctggccgccttgaccacggccggatcatggcggacttcgtcgacggcgtgaatgagggcgaaggcgagagccagttgagcaaagttgaggcgagccatggcagtggacccttcgttgctgtcggtgctatgcctgcaacatagcgtcacttagtgcgcggcgttcacactatgacgacatcgactgcgtcccgcggccgttcggcctccctgccgggtctgttcgtccacacctcgggcctgttgggcgccctcgcccctggctgtgtcggccatgccgtccaggatgccgagagcgggggcgagaacggcctcacccccgcgccgtcaccagcgggtacgtggcgcgcggcgcctacgggcgccctgtgacacggaggcgtagcagggtgcggcggccgcgttcggcgacttccgggtcggcgtgggtgctgccgtaggcgataccggaaacggcgtcgaaggccgactcgcagtccaggcggagctcctcgaccggggtcagcggcctgccgtacccggcgaggaacgcggcgcgcaggtcgggccggccgtcccaggtgccgctcaggcgcaccatgtcccgcgtggcggtgccgtactccgaccgctcgaagtcgaacagccgtggctcgccgtcctcgccgagcagaacgttgcggtactggaggtccccgtgcgtcggtaccagggccggccgcgggaggtcctcgtacgtgcgggccagggcgaggaccaggtcctcgtccccgtccgccaggtacggccgggccgcgtccagccggcccttcaccccggccgcggccgaggccgctccgacgggctgttccggggcactgtggtgcagcgcggaggcaagacggcccaacgcctgctggacgcctgcctcggcggccgcatcgaggaccatgccgtgcagtggccgtccggccaggggggtgacgacgacggcgcacgccgcggggtcggccgcgacgaggcggggagcgtgtgcgccgagtgccggcacccacctccggtacgcggccacctcccgctcgtggaacttcggtccccggtgccgcttgaggtaccaggttccgccgccggcgccggtgatcagccacacccggcttccggtgcgcgcccaggaggcgtcgaccgcctcggtgatccggccgaccgcctgctctgcgaacgttcgcagtcggtgcggcaactccgcgccgccgacgggtggtccgggcagcggacggctgcggtcggggtcgccgcgggtgtaccggatcgggtcgccgggccgctggaagtgcacggcggcgggcagcccggcgcggtaggcgtcgaggccggcccggcagtaggccaccatcgggtccggcagcccgtccagcgggtaccagcccatgccgtcgcaccggtccggctccctcacctccggccggcccgaccagcgccgtacctcgaagaacacgccgatccgggaatgggcgcccaccggagggcgatggtggacggtgacggcagcggtcacgtcctcgggggcgatcaccactccggtctcctcgcgggcttcccggatcaccgccgcgagcatgtcctcgcccgggtcgaggtgcccggacggcaggtgccacagcccggacgcgtacaccggcccggcgcggcgggacagcagtacctcgggaccggtttcgccgtcgcggcgcaggatgaggtggacgtcgaccggcacggtgtaccgggccccgccgctcaccgtgcggccccggggcagcgggtgccggagtctccggtgaccgtgaccttgcacgcggtctcgcggcacacgcaatcgccaccgcctgtcgccgcggtgggcattttcgtcatccgtgggtctcctcggtcgggtgtggggagccgtcggcacagatcctcccgggctcgacgcggaaccgggggccgatcgaacaaccccccaccaacgagtccgaccacggagcgagcccgcgggaaaaccgtgtggcgcaccgcggcgaccgctgctacgtttccggaggccgtgcgagagaaagaggaggtggtacccgtgaacgcagtatcgacacgggtgctcccctccggggtcacggtcgggcgataggtcgtccgggagcgccgatacgagccctcccgaaaggcacgaccatgcacttcatctccgagcagcgcctcgacgacggcgtcctcgaacgcgcattcaccctcggcgagatccccggcaccctgtggacgcccgcctccgccgcaccggtcccgctgatcctcatggctcacaacaacggcctgcccagggcggcagcccgcttggcggcacgggcccggcattccgcggcgagcggctacgcggtggccgccatcgacgcccccgggtgcggtgaccgaccccggtccgccgccgacgagcaggcacgcgccgacctccgccgggcgatgcaggcaggcgagccggtcgacgacatcttcgagtccttcatcggcccgctggtcgaaaaggcggtcccggaatggcagaccaccctggacgccctcctcgcgctccccgagatcgccggcccggtcgggtactcgggatggacggccgtcggcatccgcctggcggtggtcgagccacgcatcgccgccgccggactattcgccgggggctacgttccccgcgcccagcgcgaggaggcacggcaggtcaccatcccgctgctgttcctgctgcagtgggacgacgaagggaacccccggcaacgggccctggacctgttcgacgccttcggcagcacggagaagacgctgcacgccaacatgggcgggcacgtcggcactccgtggttcgaggtggaggacggggtcaggttctgcgaccggcacctgaagtgaggcaggcccgtcaggccggccctccccggagcgccgtcgcacgcaatgccgtttgtcccgaggtgcgttcgcggtcggttcgggtagccggtcgcacgacaggtcgtactcccgtctgcggcccggcggcggtatccgcggcccggacgactgactgcgcgacagggggagacgcgcgtcaacgcgtgtggcgcatgggtccaccggtccggggcagacgaggcatcggtggcggcgagccgcctgtgacggcggcgtgtacgaaggagcgagatcgtgatgatggctcaccccgcggtactggcacgcctggtggcggagtacgagagggtgtccgagcctgaggcggtgagccgtcacgaaccggtgcggcagcggatggaagacgtggtctacacactgtgcgtgacgaccgggacgcgtgacatagacgccgcgctggccgcggcccgggagcggctgcgcaccgcacggctcggtgacgcggacgccccggcgcaggcgcaggacgaccggaccctgaagggtagggcggggtagtccacctggtggcctgccgacggcacgggcggccgtcggcaggccgaaggtcaggtgtggacgcggctgttgactccgtcgtggctgtcggcctgttcgtcgtcgaaccagtggccgtcgaccgcgaggtagcggaaggaatgggcggtgttggcggagagggcgaccgtcgcggcgcgggtcccgtcgccgcgcggcgccaaggggtgagcggcggggttccagtggttgaagtcgccgaccacgctgacgggcccgtgcggggtctcctcggggaggatgaaggtgacctgggtgcggcccttgagccgcttgcgttcgagcactgaagtctccagccgcgaagaaggggaaaccgggcccgtgcatcctcgcgctgccgcgcgtgcggcgcgaccgtacagcgccgtaagccgggcagaggccacccggatggtcgcgagccgccgacgcctgcgtgggtcagccgccctggcccacgcttccgatcgggccgacctcgaccgcggaaccggagccgtccgtgacgggcagggtggctgcgcccggccaggcgagggtgaccgacttcgtctcgtccggcggggtcacggtcagccccgtgacgcgcacgccggaaccgcccgacgtgttgagcgggtaggtgacgccgaaggagaccgccgtccccttcttgaggacggccggaccggggtgctcgccggtgcgcttcgcggacagcgtcccggcgctggtcttcaggtcgacgcccgcgtactcggagagcgtgcagtccccgccgccgcggttcttcagctgcaccgcgacggtgccgtcggtgtcgccgccgacggtgctgtcgatcgccgtgatctccaggtcgtcggtgcggcacttgccggccttgccgctctcgccggagcccgagcccgagccggtgttcgtgccggcagtcttgccctccccgtcggaactcgtggccggggccggcgcggcgggcgcggtgggggcggtggagctgctggaagaggtggacgagggcgacgggccgccttgcgccgtgccgtcctcgccgttctggcacgccgtgagcgtgaggccggcggcgacggccagggcggcgaaggtgagctggtgaacgcgcatcgttgcatcctcggaatcgatggtcggtacgagcgagcgtttctgaacacgaggacccgtcggggccggccgaccgttccgttccgccgccccttaataccttcctgttacacacacagccggggtgaccactctttagcggaagttgcgcaacgagccttctgaccaggccggcggcactaccgtccacatctcggtatgcgtcctgccctgcccgagcccggtaccgggcggtggcgccaccatcgacgccgcctcggaggctgcctgctcatgcgcccaggatcgcctcgcaccggaacctcactgaccgttctggccctgctcaccgccgtgttcgcgctgatcgtcggaggcgccggatcggccttcgcgcatgccggcctcagcggctccgaccccggcgacggcgtcgtcctcaagacggcaccgaaagcggtgacgctgaccttcaccgagtcggtcggcttctcggacgactcggtgcgcgtgctgtcgccgggcaacgagcgcgtcaacccccgcccggccgagcacgtggacggtaaggacaacaccgctcgggtggacctgtccgacgaactgccccagggcacctacacggtggcctggcgggtcgtctccgccgacggccacccgatctccggcgccttcgtcttctccgtcggcgagccgtccgagaccgccgccgtcgtcccgaccggctcgccgacggacacggcggtcggccgcctgtacggcttcgtccgctacgtcgcctacagcgggctcgccctcctcgtcggggtcaccgcgttcgtcgtcgtgtgctggcccgccgcggcatcgcttcgtccggtgcgccgacagctggcggtgggatgggtgatgctggtggcgtccaccgtggccctcctgctgctgcgtggcccgtacgagacggccggcccgctgacgtcggcgttcgacctctcccaatggggccgaacggccaccggtcggcccggtggagcactgctcgccaggctcgcgctgctcgccgtggcggcggtggccgtcaagcggtcggccgtacggttccacggtcaggacggcggagccgagccgcaggccctcggttcccgcgcccggccggccggggcggtactcgccctcgggctggcgctcacctgggccgcggccgagcacgcctccgccggcatccaggtcctcctcgccgttcccgtggcggtcctgcacctgctggccatgggggtctggctcggcggcctgatcacggtggtactgctcctccggagccggggcgacaccgctcccgcgattccggcggccgcgatgagccggttctcgacactggctttcgccgccgtcgccgttctcgtcggcaccggggtgtaccagtcctggcggcaggtcggctcctggggagccctgaccacgacgtcgtacggcaggacactcgtcgtgaaggtggccgccgtggccgtcgtgctgtgcgtggcgttcttctcacgacggtggaccgcccgcctcgtgcgtgaagcgcctgcggccgcgcggaagttgaagctgaagctccgtgagcccgcgcccgagcgggtgagggagacggccggcgcgccgtccgtcccggcggcggcggaacccagcggccggcccgagacgcctcgcggaggcgaggcagagggcacggacacccagcggccggttacgcccgccgacgcatcccggcgacgcctgcgtcggacggtggccgtggaagtcgtactcggtgtggtggttctggcgatcaccaccgtgctcacaggaacccagcccagccgggcggcagccgggagtgccacggcagccgcggggcacgagccgcaggtgcgggtggtcaccgtcccgttcgacatggggacggcgaaccaccagggcagcgtacagatcagccttgagccgggacgggtgggggagaacacggtcgaggccgtcgtgtacaccgcggacggaggcctcgccaccgttcccgaactccggctgacgctcacccaggaggacctgggcatcggcccgatcgacgccaagctcacgaaccagaaggggtactgggccgcctacgacctgcggttgcccatgcccggcgagtggaccatgaacatcacggtgcggaccagtgagatcgaccaggtcacggtgcgcgagaccgtccgcatcacgccgtcgtcctcgtagacgcccgccgccgcacggccgggtccggtacaccgtacgaaccgtgtaccggacccggccgtgtcggtcaggcctggccgcggccgcggttgcggcgcaaccaccagacgatgccgacggcgagcagtacgacggccgcggccaccccgacgaccgctccggtcctgccgcccgtgtccttctcagcggaagcggcggaagccgggggagcagcggcagccgctgccgacggcggggcggacgggacggtgctcggcgtcggtgacgcgctcggggcgatcggcttcgccccggaggccgccgccttcaggtcgagcacgggggccggattgtcgaccttctccccgccggtgggcacctcgatccatcgggagaccttcccgtcgccgtacgtctcaagtgtcttgaacgccaacgacttcgcgtcgggcagctgacgcaccgtgatgctgtactcggcatcggtgcccgtggccagagcggcgccgccgacggcgtacccgtccggggtgggcgtcagcttccactccttgggggcatccttcagcgtcacggcgtccggggtgatgcccgtggggaggacgacccgcagctccgagatgccggcggtgtccgactccgcttcggaggtgaaggacagcgtcacgttctcggcgagggcgcgtggatcggaggcggtgacctccgcgtgcgcggcggcagggccggcagtcatggccaccagcaccagggagccggccgccgcaagacccagcctgcggcgcagggggcgggtgtgtgtcgtgttcacggtgaggaaccctctcggtacgcgggcgggccgcaccgcaccggtgcctgcccgccaggatcaggggaacgtctcctgcccgcccggcaggaggcccccggcgtaccaccgcgtcacagagcatcgttgccaccgccggtcgtacggcagggccgtcaggcggtacctgcacgatccggggacctgctccgcgcgccggcccgcggagagcaccgaaagccgcggcgacggccgcgacggccgccacagccttctcggcccagcggcccaccgtctccggcagacggctgagtacctggtccgcgtggtacatgagcagagccatcacgacggcggccacgcagtgggccgccggcatcgcccacgggctgtggtgtgccgtgcggacgacgtccggcagcacgccgtgggctgcggcatgaccgtgatggaccggctgcctcacggacagggcccggtgcaggacgagttgcgcaacgcctgtggcggtgaccacctgccaccacggagggggccgccgggtcacggaccacgacaacacgaacgcgcacgccgacccggccgccacccgctcccagggcacagggtctccggcggcaaggtgatggcccgcaaccgccagggcggagctgagcagtgtgaacacggcagcccgcagccgacgtccgccgggcctctcgggccgtggacgcgagcgcgtccctgcagggtccccggccatgtcgggcccatcattgaccggccccggacacccatgagccccaactgtcaattcaggagcagtttttcccggcaccgcatccggtgtccctcggtcagccccccgcacgtggtcgttcccgccacggccgaggccgtcgaacgccgctgccggtggcgggacgagtacccgttccggcggggctctaggaggtcctgccctccccctccgaggtgcccgaggtgcccgaggcgcccgcggcgcccggggccgccttgcgggcatgcaggacgctcgcgcccagcgggagcggtgagtgaccgacgagccgcaggcccgcgtcgtcgagtagttccgcgtagtggtcggcccgtcgctcccgaccgccgacgttgcacatcatgtggaggtcccaggccgtcgccagcgacggcgagccgtccggcggcagcagccgctccacgacgagcaggtcggcgtccaggggcatggcccgggcgcagtggcgcaggatctcccggcagcggtcgtcgtcccagtcgtgcaggacccgcgccaggacgtacacggccccgccggcgggcatgtcggcgaagtcgcccaccacgtagccgcagcgggctccgacgccgaacgtgtcgaggtgccggcgggcggcctcaaccacgtgcgggcgttcgagcagcacgccgtccagccccgggtgcgcggccaggatgcggccgagcagttcaccggtaccgcccgcgacgtcgacgaccgtccggcggccgggcgcggcgcccgccgcggcgatgaccgggtggagggggagcggatcgaacatgcgcgcgctcgcggccatggactggtcgaaacgttcggccagtgcgggccggcgggcgaagtagtcgaagtggttctcgccgaagagctgctcgaagccggtctgccccgttcgtacggcatcgctgagcagcgcgaacgactggtagaacgcacctccgtacatcagcgccagcgaccgcatcgacccgtgggaatccgcgcgcagaagcaccccgagctcggtgaggcggaagccgccgggctccgacgtgaccacgccgagcatggcgaggtagcgcaggagggtggcgaggttctccgggtcgcaagggaccgcccgggccagaacgcccacgtcgacggcggtgcgagggcggtcggccccctgggcgtccatcgcctccggcagccgcagttgcgcgcaggcggccagggcctgggtcgtccacgcgccggtcatcaggcgcaggagcgtttccgccggctgccgggcctgatatgcggcgaggtggggggtgagcacggcgcggtggtcgccgctcgcgtagagctcgacccgcccgtacccggccttcgagtcggcgggcgcggtgaagtagaacaccgtgccgtcctcgtgggggttgtagccgcctccgtcggcgaccgcaccgtgctgcgcgaacgtctcgcacaagccccgcagcaccagtggatcggggcggtcgacctcgaaggcgaggtgcgcctcgtggtcgtgggcacgctcgtgcgcggcgacctccacgagctccgagccgggcgggacggccagggcgaagacctcgaccacccggcgctcgccgtcggtgcagtgcacttcggggcgcagaatccttacgtccagatccgccgcgtcacggcgatggcgtacggccagacgctcccggacgacgacgctcggctgcgcggccgcgtacgcgtcgaggccacaggcggccaactgctcacgcagagacgattcgtcgggcggacagaccagcagggcggcgtgtgcgaagtggcagcggtcggccagcgcccgcagctccaggccgtcgaggccgggcagcaggaggcgcagcagggtggcggtgtcctgctcgcggacgaagtccgccgccccgctgaggcgggccgtgtcgtcgagggtgtgcgcggtgaccgcggtcggtgtcgtcatggggaaggcatcctcgttccggtgtatttcggtcatcgggaggcggcggaggcgacggaggcgcctcggtggagaaggggaggggaggtggaacagctcgcgggcagggaagagccgcccctggacggaggcagagcagaaatgggtcaggggcgggtggcgggagttcgaagaggcggcggagacgggcgcgcgggaagcgggcgccggggtggccgggggaccgggcggtcgtccgcgagctcggcgaggtgggcgaggcgggcgctcagagaccgacgtagttctcggcgaaccagtcctgctgggtacgcgagctccgcagcgcctggagccgggagtggcgcagccggtcctggaacggcgagccgccgtccgcaccgtcctgcgcgccgcccgcctcaggctccgcgtgcagcagccggatcatccagtgcgagaactcctgcgcgcgccagatgtacgccaggcactgcgccgagtagcggtccagcggcccggggtcggagtgccggagggccgcggtgaggccgtcggcgaggatctccgcctccagcaccgcgaggttcgcacccttcgcggcggacgggctgatcaggccggcggcgtcgccgacgaggaagagcgagccgtgccgcagcggctccagtacgtcggactccaggtccacgacggcgcgttggacgatcgggccgctccggagcgggccgtgggcggccgcgcccagccgcagcgcgagctcgtcccagatccgttccccggaccaggcgccgggtgccgtcccccgcgggacctggaggtagtagcgcgtgacctcgggggaccgggccatgtgcccggcgaacccgcgggggtggaccgcgtagcccacggcgtcgaggctcggcggtgcctgggcgaggaggccgagccaggtcaccgcgtggtcgcggtggtagcggcgtaccgctccggccgggagcgagcgccgggcggcgccgtggcgcccgtcgcatccggcgacgtaccgggcgtgccagcggcccgggcggccgtccgcgtcgcgcacgtcgaccgtcggccgggtaccgccgaagttgcgcacggcctccgccccggtctcgaaacagatccggccgccggcggtgaggtaccggttcaggaggtccgtgaccagctcctgctgggggtagacccagtgctgctcgcccttgccgagaaggctgtagtcgagccggaagcggtcgtcctcggtgcggaactcgcagacgccgtgttcctgcccgcgccgacggagaccctcggccaggccgtggcgctccaggatgctcacggtgtgctgggcgaggtagccggcgcgcgcccgggtctgtacgtgctcgcgcgcggcgcgttcgaggatcacgcagtcgacaccggccgcgcgtaagagattgccgaggacgagccccgcgggcccggctccgaggatgaccacgtcggccgagtcccggaccgttcgggccttctgactttctgtcatgaagatggatcataaacagtgaaaattcattggatcggcgaaaatcacccgaatgccacagtgacgggtggggttcctgaggtttgagaggtcatctcatctgacgcgcccggcctgccgccctcggctgcgcggtgggatccagaacccgggtcgccggtgccccggggcgaaccatgacggaattctgacgtcgcaccggtctccctggcttcccggacccgcggatgctgcaatcgaagggtgaccacagaccaccccgacaccgagggcgcccccgtcggccgccgtctggtgctcggcatgctcgggctcggcgcaggaggcctcgtcgccgcaccgtacgtgcagcgcgggatcgaggcgttcctcggggccgcctcggacaaggacccgaccggcctcaccgggctgctgcccaacgggggcggcttccgctactactccgtcgccacctccgtaccgcggaagaacgagcaggactaccggctcaccgtgaacggcctggtcgaccgccccaccacgtacaccctcgacaccctgagcgcgctgccgcagacccgggtcgtacgggacgtgcagtgcgtcaccggctggcgggtacccgagaccccgttctcgggagtcaggctctccctcctgctggacgcggccggtgtcggtcccggggcgaaggcggtccgcttcacctgcttcgacggtacgtacagcgagagcctcaccctgcagcaggcccggcgcgacgacgtgctggtctgcctgcggatgcaggacgagccggtcagccacgcgcacggcggccccgtccggctctatgtcgcgccgatgtacttctacaagtcggcgaaatggctctccggcatcaccgtcacctccgaggtgcgaccgggctactgggaggagcggggctatgacgtcgacgcctgggtcggcgggtccaacgggcgcagtgacacccccaccgtctgagccgcaccggcggatcgccaggttcacccgcgccgagcgctgggtccaccgtacgaccgccgcactgacgctgctgtgcgtggcgaccgcggccgccctctacgtaccccagctcgccgaactcgtcggccgcaggtacctcgtggtgaccgttcacgagtgggccgggatcctgctgcccgcccccttcctgctgggtctggcctcgcccgccttccggaccgatctgcgcaggctgaaccgcttcgggccgcacgacgggaagtggctgcgcgcggtgcggcggcgagaccaccggcccgggtccaggcccgcgggcaagttcaacgcggggcagaagatctacgcgtcgtggatcgcgggcgcggtcctggtcatgctggcgaccggtctgctgatgtggttcacccacctgacaccgctggtgtggcgtacgagcgccaccttcgtgcacgactggctggccctggccgtcggagtggtggtggcagggcacatccggatggccctcgccgacccggaggcgcgcaggggaatgcgtaccgggtcggtcgagcggccctgggcggagcgggagcacccgttgtggacggcggaggagccgaaggacgagcgcgcggaacggccggaggaccgggcggggaacggatgaggggatctcggcccgaaccgggacgaggccccgggtgggccgcgggacaacgccgggaggacaccgggacgaccccggcacggggaccggtcccgaccgcgcgcggacggctcagcgggaccggcggccctgggacacggtgaaggcgacgaggaatccggccagcccggcccagacggcgccttcggaaccggcgtgcagccagccgagggctcccagggccacgacggtgagcgctcccgcggagacggcgcgggggtcggcgaggaacgtccactggcgccggccgctgccgggctccctgagctcggcgaccgcggttctgatgaccagggcagcgacgacgaccgccacggccaagagggtcgctcccatgtccgctcccgatgtcaggtccggtcggaacctgccgcgtccccggctttcccccaccccttgcaatctacttcccgtacggcgaaacgtctcgcgccctgggcagcggcgccttcggccccgggccccgctggtccccgccacgggcccgggtgggcgatcatgcaggtgtagtgggtacggcacaggcacggagggttcgacggtggaggctgcgcggggcgcggagttcgcagcggtggcggggctgctcgaaggtgcggcgcaggggcagagcggcgcgttgtggaggctggagggcgccgagcggcagctggacgtcaacctggtgcgccacctgcccggcaccggcggggcggcgtacaccgaggacgaggtcgacgtgatgctggtcgtcgtcgcgggcggtggcaccctcaccctcgacggcaccgtgtcccagctggctcccggcttcctcggcctgctgccgcgcggcacctcccgggcgctgctggccggtcccgaggggctgatcgtgctcaccgcgcaccgcaggcgccgcggcatgcgcatcgggcgggcggaacccgccgccaccaccgcggccgagcccgctgccatgcccgggtcgtgcgcgctgcacctggtgtgcgggcggtgtcaccggcacgcgatcgaggcggacgcccgcttctgcagcggctgcgggacggcgctgccgagccggcccgcggcctgacgtcccccgtgcgcggggtccgcgtacgggggcgcgggccccgtaccggtgcgtccccggaccggtcaggaatggagaagccacgaccgcggcgcagcccctagcgtgatggtcatggcaaccaccgctttcaccgcagcccacacgtccctcgcgtccgtcacccttgaggtggccgatcccgaggccgcccgccgcttctaccgcgccttcggcgtggactcgtacgtacgtcttcgggcgtccgaggcgcactccaccggattccgcggcttcaccctggggctcacggtgtcggggccggccaccgtcgacggcttcgtcgccgccgcggtggacgccggtgccacggtgctgaagcccgccgtgaagtcgatgtgggggtacggcggtgtcgtccaggccccggacgggacgatctggaagatcgcgacctcggcgaagaaggacaccggcccggccacccgcgagatcgacgaggtcgtcctgctcatcggcgtcgaggacgtgaaggccaccaggcagttctacgtcggccggggcctgaccgtggccaagagcttcggcggcaagtacgccgagttcgcccccggccagtccagccccgtcaagctggcgctgtacaagcgccggggcctggccaaggacctcggcgtcccggtcgacggcaccggctcgcaccgcattgttctcggcagcaccgccgactccttcacggacccggacgggttcgtctgggaggccccggcgtcccccgcgcccgagctgccgtgacagatcggcgacgggcggccggcgctgcttcgcggacacggcccgggggccgtcacggtgacaacgcggccgtgttctccacccgttcgcgcacttcggtcgtgaaccccgcctgccggagcgcctcgaccccgagcccggtcgccatcgcgaggacgagatgaggggaggaggtacgcgagggaacggcctccgtgccgttcgcgacggacttcagcacgcccaggccgccgacctccggcacgtcgatgctcgtccagaagaccgggcggtcctcgatggcggcccgggcgaacacggggtggggtgcgagacgcatgcccgccgtgcgggcgaacgcgcgctcggcgggggcctcacccacgaagacgcagtcgtcggccgggccgccggtgctcgcgacggcgtcgtcgaagatcgcgcggctgtccttggggccgaagtggaggaggcggtcgtccgtgaaccggccgggaaacgccgcatggagagcgaccgtgagccgctcggcggcatcctgttccgtgcccgggttggagatgatgcccttcggttccgctgcgagagcgtcgagaacctgcgagacacgggggaggggcgtcaacagccaggatccgtccggctcacgaacgccgtccgccagggtcgccccgatgtcgaagaagagcgtggtcatctcggcgcctccgatggttgaacggcgcacagttgaaaccagcacctgaaccccgcaccgcacgccggtccgagggcccctcttcatggtccgtccgtcccggcatacccgcatgacgaaatcgggaaccatcggaatgacgcccggtcgccggtcgtggtggtgccccgcacgcctccggtgccccgacggctgttggccctaccgtgcaagcgacccgtccgtatcccggaccacgtcccgccactcagtcgtttcccttggaggtcgtgatgcccagtcccgctcagccgttcggcacggtcgtcagcacgtccggcgtcaacctgcggaaatatccgagtaccgactcctccctcgtcggcaacctgaaccacggcgccgagatcggtctgcacagcaaggtgcacgcccagaccatcgacggcaacagcatctggtacctgctgcgcgaccaggccgtgtgggtcgccgcccgccacgtcgacaacaccggagaggtgccgctgtccaaggacgcccaaccggccgccccccagggctgacggccggccctcggatggctcccggcgtccgggggcggcccgcggctgcccccggacgccggatcgagcgttcgtgaggtgccggtacgaccccgatgccgttgagcaggcccagttgacagcgagcggcgggccgtccggggcggccgggcgatactgagagaggcggacgctcgacctctggattccgaccacaccgggtggccgccgggggattgcccgccgagcggagggttcggcaggccgaagggtggcagcgatggacgcaccggcgccgggatcgggcgaggggcccgaggacccgtacgcgctgaacaactcggcctcggcggtactggacgaccacggcatcgtcgtcggctggagcgagcgcgcacaggagcacctcggctacctgcccgaggaggtgctgggacggcccgccatagaattcctgttcgatgaacgtgcccgtgaggcggtcctggacgcggtggccgcgtacgagcacgaggggggctggtccggtgtcctgcccgtcctgcaccgcagcgggcggcgggtggaactgggcttccgcgcccgtgccgtcgtccgtgccggcccggcccgggagtggttcctcgtcgtggccccggccgaggaggtgctgcggtgggagacggaccggtcggtcctggacggcctgttccggcgctccccgatcggtctctccgtccacgcccccgacctgggcatcctgcggatcaaccgggcgctggcccgtttcacgcagctttccacggcggagatccggggacggcgcatcggcgacttcctcatcggcccggacgtggagaccatcgagaccaggctgcgcagggtgctggagacgggcgccccgctcatcttcaccgagcagccctgccgtctgaggagcgaccccgaccacgagcgcgtggtgtcggtgtcggcgttccggatggaggacccctccggcgagatcctcggggtcacccaactggtggaggacgtcaccgaccgctaccgggcccggcggcggctcgccctgctcaaccgggcgagcgcccgcatcgggaccacgctggatctcggccggaccacttcggagctggccgaggcagccgtccccgacctcgcggacgccgtctcggtggatctgctggagtcggtggcccgtggcgacgagaccgccgaggaggcgagcggacaggtccgcagaatggccgtccactcggtcgtgccggaggcgctccaggtgatgtactccgccggagaggtcttccgcttcgacccccgtaccccgcaggccaggtgcctcgccgaacagcagcccatcctcgaaccggtcctccggagcagccccggctggtacttccaggacccggagcgcacgcagcgcgccctcagcctcgacgcgcactcgctgatcgtcgtaccgctgacggcccgcggactgctcctcggcctgctcagcctgtggcgggccaagcggcccgaaccgttcgaggaggacgacctcacgctcgcggaggaattcgccgcccgagccgccctgtgcatcgacaacgcccgccgctacacccagcagcaccgggccgcgctcaccttgcagcgcagcctgctgccgcaggagttgcccgaacacagcgcggtcgaggtcgcacacctctacctgccggccgatcccgccaccggcgtcggcggcgactggttcgatgtcatccccctgtccggagcgcgcgtcgccctcgtcgtcggcgatgtcgtcggccacggtctgcacgccgcggccaccatgggccgcctgcgcacggccgtccacaccctggccggcctcgactacgcgccggacgaggtcctctcccacctcgacgacctggtcaaccgcctggcagaggagcaggagccggccgacggacgcccgggaggccggcagatcgtcggcgcgacgtgcctgtacgcggtctacgatcccacctcgcgccgctgcactctggcgcgggcgggccacctgccccccgccgtggtcgcctccgacggcacggtgagcctgcccgacctgcccgaggggccgccgctgggcctgggcggactgcccttcgagtccgccgaactcgaactcgccgaggggagtctgctggcgctgtacacggacggtctggtcgaggcccgcggcctcgacctggacctgggactcgcacggctgcgggaagccctgtccgggcccggcggctcgctgcaggagacctgcacggcggtgcaggaggccctgctgccggatcacccaccggacgacgtcgcgctgctcctcgcccgcacccgcgtgctggcgccggagcaggtcgcctcctgggaactgcccgcggagccgagcgccgcctcccgggcacgcgacctcacggaggccacgctgacgggctggggcctggaggagctggccttcaccgccgaactggtcgtcagcgaactggtcaccaacgcctaccggtacggcggcggcaagccggtgaccctgcgactcatccgcgaccgcagcctgatctgcgaggtctccgacagcagcagcaccgctccgcacctacggcgtgcgcgcaccacggacgagggcggacgcggtctcttcctggtggcccagctcaccgaccgctggggcacccgctacacccgggacggcaagaccgtctggacggagttccccctggccgcggcagccacgagcaggagccgggcgggtgcgtgaacgggccggcgcgtgcagtccgtgcgccggcccgtcctcgccgaaagcggtgcgatcagcagtcgtcgtcccagcctccgccccagccgtgaccgtggttgtagttgccgtgcccatggccgtggccgtggccgccgtacctgtggccgccgtacccgccgtacccgtcgccgtcatcgtcgtcccagccaccgccgcctgcgacgtaggtgaccgagtgcgtgggggctgcggccgaggccgtacccgcggctccgagggcggcgccacctgccatcagaacaccgatggcggacaccgcgaagagccgcttcactctcagtgcttgcatgatttcgaacccttcatgtcgttgtcgtgtcacgcaatgggggcgtgatgcgcaatgccctcccgcgcaaggggtgaagcgcggttgcgtgcatgaccgcatgggtgcgtgcgcgcgtatcccctgtcaacgccacctggttggggcagcggacctccgggccgacgcgcgatccctcaaagcatggtgctcgggagcactactgcgggctgagtgtgttccccgcagttgcggttctcatttagagacgctagtcctgaatccggtgttcggcatctcgggccggaatccggtcgcgtgcggccgccgggcggcgggccgggcggcgggccgggcggccgggccctctcccgaatcctgcattcggggcaggccgggaggggccgcagcgcgcgaacgtgccgcgtgctcaggttagaaccgccccggcgcaccatgcgtgagaagggacctggtcagcccttcgggtgacatccgatgcgaacgcatgatcagtccggggggcttcgcggtgtgtctgcgcggccggtggagccgcagtcccttcaatggcgccgcatgaccttctccgcactgcaccagccgccggcgcgcgccgcggctccgtacacccgtcggtcggtcctcgcaggagccttcgccctggcggccgccacggcactgccgctcgccgcggcgggccgggcgtactccgccgcggtccccgacatcatcggctgcgccgcctggggcgcgcgggcggcgtccgagccggtcgtcgtcctcgccaaccgtccggagcggatcatcgtccaccacacggccacggcgaacgtgaccgactactcgatgcagcgtgccgtcgccctcgcgcgcgcgatccagacgtaccacatggacgcgcagggctggatcgacacgggacagcacttcaccgtcagccggggggccttcgtgctggagggacgccacaacagcctggcggagctgcgcaccggcacccgccaggttcgggcggcgcactgcgtcggccagaacacggtgtcgatcggcatcgagaacgaggggacgtacacctcgcaggccccgccggcggcgcagtacgcggcgctggccgacctgtgcgcccacatctgcgaccagtacggactgcccgcgtcggagatctacggccaccgcgacttcaacgccacctcctgccccggtgaccacctctacgccatgctccccaccctccgcaaggacgtggcggcccgcctcggcatgcccgcgccggagccggcggagggctccgatcccatcggggacctggtccgcgaggccaccggccggccggcctcgccctacgcggaatacctcccggcgggactcctgccgtgacgtgatgacctgatgacgtgacgggtcagcgggccaactcgttccccgggcaggtgagttgtcgcccaacgggcccgcggtgccctcgcgggggagtcacaaccgccagtacgtaccggcgcgggcatcgacgtgcaccacgtggtggccgacacgcaccacgtggtggtccgggccggaccaggagccgcacgtgccgtcggccgcggacaggggggtccagatttccaggaaggtgctgccgtccgggttggtgccccgctcgacgaggttcgcaccgtcccaccggaaggttccggcgtcttcgccgggctcgcccgtgaggtggtggaagcggacctgggagccgtcgaaggacgtcgtaccggcgaagccccggctgtcggcgtagtacggcccggcctgcagccacaccacttcccggtcctcgacgaggggtccgccgtcgcggctgatgccgcgccgcagccaggcgccgtgctcgggcaccgggactccgggaccgtcctgggcgtgcgcggccggtccgggctcaggcgcggtcatcggcggcgggctcgtccacggccaggagcgtcagcggtacgttgccgcgcacggcctgcgagtacgggcacaccgcgtccgcccggtgcagcaggggcagcaggtccgcggcctgccacccgggcaggccgacggtgagcgtcaccgcgaggccgtagcccgccggagtgtccgtggtgccgagctggacctcgcaggccacgcgtgcggcggaggcgtccgccccgaactcggcggcgacctccgcgagcgcggaggtgaagcaggcggcgaaaccggccgcgaacagctgctcgggattggtggtgccgggtaccttcttgcgcggcggggcgaggcggacgtccaggcgtccgtcgtccgtgcggacggatcccgtacgtcccccctcggcgtgcgcggtcgtccggtacaggctgcgggtgagtggcactggaacggtcacggtgttcggcccatcttgctcgacgaggacgctgcccgggtgcggacagcggatgacgctgctcgtgcagcatctcgcgcgtcgtcgtgcgtaaccgggtacggcgcatctcgtccggggccttggaccggccgccggacaatctagcaacccggaccgcggccgcggagcatcccccgcggtgaagtagctcacccgcctcccgcggtgcccgcacgccggatcgccgggccgtggcggtccggccgcggcccggccggccgtgccgtacgcgcccgtacgcgcgcccgcacgcctccgcacgcccccgcgcaaggggatgaccgtcgaccgccgggccgtgaccatggccgtcaccaccacatcacatccggaacggctcactggtcacgggggaacgatgggacgacgctggctggtcacgggatgctcctccggcctcgggcacgcgctggccacggccgccgcccgggccggggacgcactggcggtcaccgcccgcaagaccgccgatctggaggacctcgccgcggcctggcccggccgcatcgtcccgatcccgctcgaactgcgggacgccgcctcctgcgaggaggccgtccgcaccgccgccgaccgtctcggcggcatcgacatcctcgtcaacaacgcgggcatcggactgttcggcgcggtcgaggaggtctcggacgccgaactgcgcgaccagctggagaccctggccgtgggcccgtggcggctcacccggctcgtcctgccgctgatgcgggcccagggccacggccacatcgtcaacgtctcctccgtggtcggccggatcgccttcccgggcctggccgcgtacgtcgcgggcaagcacgccctggagggcatgagccaggcactggccgtcgaggccgccccgcacaacatccgcgtcacggtggtggagccgggcatgttcgccacgcgctacggcacgtccatggcgcaggcgcaccgccggatcccggcctacgacgccaccaaccgcgagatgctcgaaggcgcccgcggtctcgccgagcatcccgagaccgggcgccccgaggacttcgccgctcgggtgctcgacatcgtcggggccaaggaccccacgccgctgcggattccggtcggcgacgacgcgtacggctacctggaactggccgagcaggcctcacgcgacgagttcgcggcggcccggatcctcacgcagggcccgcccgcccccgccgccgacctgacggcggggcgtgcggccgcagttgaccccgggtgacgggacggtggaaacggtccggggtcagcgcgcctggtgctgtataccccgctgaccggggacccgggccgaccggggagcgcccgagcggcggtggtcggctcgctgtcggcggcggcccgggaaggggttgcgccgtacggtggcgctgggggccgcgatcagaaggccgacaagcgcgaggaccgcgacgaggatgagcacggtaacgaggttcatggtcctgcctttcgtcgggtattgactgcctgtcactacatcttgttaccgaattccgggctgttaaacacagagggtgactgcacctgtgggcgagggcctccggcgatagggtccggccatgtccacgcacgaacgtgagatcaccgttcccgtcgacctgtgccgtcccgacggaacgctcgccccggccgccgtcggctggtcacgccggccgctgcaccgctgccggattcccggctgggggcggacgaagcggtgggagtactggtgcgtgaccacgccgacccacgtggtggccctgaccgtgagcgatctcgactacctggccctgaactcgatctacgtcctggaattcggttccgctgtgcgggagttcgagcgcaccgcgatcgtgccgggcgggttcggcgtccgcctccccgacaccatcgccggagctccggatccggggtctcctccgctcgtggtcgggccgccgcggccggccgggggccgggtgcggatcgagatccgccccgagggatccggcacccgcctgcgggcccggtgtcgtggtccgcggggcctcccggtggaggtggacctcctcgtcgcgatgcccgccgggcacgagaccctctccgtggtggtgccctgggacgaacgccgcttccagtacacctccaagcacacggcccggcccgcgtccggcacggtgcgcatcggccgtgaggtgctggagttcggcgacggcgcctggggcaccctcgaccacgggcgcggccgctggccccgctcggtggcctggaactggggcgcggcctccgggcgtacggacagccgcaccgtcgggctgcagttcggcggccgctggacccgcggtaccggcacgacggagaacgcggtgtgcgtggacggccggatcagcaagatcggccaagagctggagtggcgctggtcccgagccgatcacctggcgccgtggtcgatccgcagccctggaacggcccaggtggacctggtgttcaccccgttccacaaccgctccgcccgcaccgacatcggcctcctcgccaaccgcacggatcagtgcttcggccactacacgggctcgatccgcacggacgacggcgagctgatcgcggtggaccggctgctgggatgggccgaggacgtccgtatgcgctggtagtcccgccccggaagggccccgccccggcgggcccgcccgcctgcccggtcagcaggtcccggtggagaacgggccgttgtcggcgaacgccagccgcgcgaagttctcggcgatgcggcggtgcccctcggggccggggtggatcgcgtccggcagcgggaattcggcgtggtcgctctcgccgtacaggtcgcgtccgtcgaggtggtgaaggtgcgggtcgtcggccgcgcgctgctccacgatcgcggccagtgcgtcgcggatgatggtgagcgtgagtcgcccggcagcgcgttcggcgggatcgcccgtggccttgaaccggagggtcccatcggcgaagtccggcgcgaggggaccgggggtgtcctcctggaccggacacagaaggggggacaccaccagcaggggtgtcgtcggacggccctcgcggatggtgtcgaggaagccgtggacggcaggggtgaaggcgcgcaggcgcatcgtgtcgccgttcacgacattgatgccgatcttgaggctgatcaggtccgcgggggtgtcccgcatcgcacgcgcggtgaacgggtccagcagcgcgctgccgccgaatcccaggttgaccaggtccactccgccccgggcggccgccagggcgggccagatggcgctcgggtggacggcgttcgacccgtggctgatggaactgccgtggtgcagccacaccctgtgcccgctgtcgcgtgccggttccaccggggcatcggtgcgcagggcgatcagctcggtgatctccgtgtgcggaagccagatctcgacatgcttgtcaccggccggcagaccggcgaaccgggcggtgcccgcgggaccttcgctcagctccgaggtctggctgaccatgtcggtgaccgtacggacgttcccgccgggcaccgtggcctgtgcggtgagacggccgtcgaccagcaggtcgtacacgccgtccgccgggggagggaagccctggtatgcccgcctggtgggcagcgcgtcgagttcgacgacggtggcccgggtgcggaaggcgagccgcacgccggagggctgggcctcggccacggccaggcggtcgtcgggtatctgccgccgcgcccaggccggcagccggtgcggcagcagaccgtgcgcggtccgctccaggtcgaggtggccgcgcaggaggtccgcggtgacgggcgtggtgatccagtcgtgttcggtgctcatcgtctcagcccgtcggttcaggggtggggggcccggacggagtccggccccggtcgcggttgtggtggcgcagcatggcgtcgagggattccagggtccaggcccaggactcctccgagtcgacggccgtgtggctgaagcctccggccgcctccagactgacgtaaccgtggaagacgctgcccagcatgcggaccgcgtgggtctggtccggctccgccaggtcgtagccgcgcaggatcgcccgcgtcatccgcgcgtgccgcaccccggcgctggcggccgccgtggccgggtcgagcctgagccgggcggcgtcgtagcggccggggtgggcccgggcgtagtcgcggtaggcgttcgcgaaggcgaccagggcgtccttgcccgcgcgtcccgccacggccgccgcgaccaggtcggcgagttccgcgagtgcgaacagggcgatcctggtcttgagctcctgggagttcttcaggtgcgcatagaggctcgcgaccttgacgtcgaactgccgggcgagcgccgagagggtcacctggtcgaatccagcctcgtcggccagttcggcgcccgccagggtcaggcgctccggggtcagccccgctctcgccataaccttcaccttccttcgatctgacgacagtcattatgcatttacctaaaggatataggtaaaccggaccgactcatagggagcgcaccatggggctcatccacatcgagctgttcgcgaccctcgacctcgtcgggcaggcacccggcggccccgacgaggacccggtgggtttcccgttcggcggctggcaggcgcccttgctggacgaggtcggcggggcgcagatcgcagccgcgtacgagggcacggacgccctcctgctcggccgccggacgtacgacatctttgccgcgtactggccgcaccaggagggcggcgcggacgacgggatcgccgcgctcttcaaccgcgtcccgaagtacgtggcgtcccgcggccggcccgacctctcgtgggccgggtccacacggctcggcgcggacctggccggcgcggtgcgcgagatccgtgaccgccacgagcacgtgaaggtcgtcggcagcctgaacctcgtgcagaccctcctgcgcgagaggctctacgaccggctcgacctctggctgcacccgatcgtgctcggcgtcgggaagaaggtgttcgacggcggtgcggtacccgccaacgtcacgctcctcgcgcccccggcagccggcccgaagggcaccgtgtacctgcgctacgggctcgccgacggcatccccgcgacgggggacatgagcgccccggcctaaggccccggggaagccgccccggcgtaccccgtacgccgcggggtcgcggctcggcgggacggtgccgcgggcccggcatacgctggttcggggggcagagatccgggcggcgacgcatgccggaagggacgccctgatggacgagtacccgctgatcgagaaccacggcctgataggcgatttgcagaccgcggcgctggtgaccaccgacggagtggtcgactggttctgctgtccgcgtttcgattcgcccagtgtgttcggatcactgctggacaagggcaagggcggccactgctcggtccgcccggcccacgcgacgtacgcgacgaagcagttgtacctgcccgacaccgccgtcctggtgacccgcttcatgaccgaggtcggcgccggcgaagtggtcgacttcatgccgctgaccggcaccaccgtcacggaccggcaccggctggtccgcatggtccgctgcgtgcgcggcagcatgaccttcgacgtcgacatcgcgccgcggttcgactacgggcgtgcgtcgcacgagctgcacgtcacggagaacggggcggtgttcaccgccgacggcaccaccctgaccgtgcacaccctccgggaaccggacgacgagcggctgggccgtctcctctcgggcgaccgcgacgtacacctcaccctgaatctggaggcgggacaacagcgcggcctgatgctggagtccgccgccgacgggccgccccggcagatccgcctcgccgagtacgaggaactcttccacgccaccatcggcttctggcggtcctggctgagcacctcccgctacaccggccgctggcgcgaggcggtggagcgctccgccgtgacactgaagctgatgacgtacgcccccaccggagccgtggtcgccgcccccaccaccggactgcccgagcaactcggcggcgagcgcaactgggactaccgctacacgtggatccgggacgcctcgttctccgtgtacgccctgctcggcatggggttcacggaggaggccaaggcattcatcgggtggctcggcgaccgcatccacgaacgggccggcgaagcgggggagaccgggccgctgaacatcatgtacgccgtcgacggctcctccgacctgaaggaggagaccctcgaccactgggagggatacgaaggctcgtcacccgtccgcatcgggaacggagcggccacccagctccagatggacatctacggcgaggcgctggacagcatttccttcgcccagcggcacggcatccacctcggctaccgcgagtggaccggcctgatccacgtgctggactggctggccgaccactgggactcggccgacgagggcctgtgggagacccgcggcggggcccaggacttcacctacggccgcgtgatgtcatgggtggccttcgaccgtgcgctgcggctcgccgacttcagcggccgccccgcaccggcacagcactggagcgccgcccgcgaccggatcttcgaacaggtcatggcgaaggggtggaacgaggaacgcggcgcgttcgtgcagcactacggcagccaggtcctggactcgtcgctgctgcgcatgcccaccgtcggcttcctcaccccccaggaccccatgtgggcctccagcctcgacgcgatggagcaggaactggtctccgacagcctggtgtaccgctacaaccccgaggcgtcgcccgacgggctgcgcggctccgagggcaccttctcgctgtgcaccttcatgtacgtcgacgcgctcgcccgggccggacgcatcgaccaggcccggctcgtcctggagaagatgctgggctacgccaaccacctgggcctgtactccgaggagatcgacctgacaggacgccaactgggaaacttcccgcaggcgttcacccacctcgccctcatcgacgcggcgatcaccctcgacgcggccctgaaccggggctccgccccgtaggaggtgcccaggggtttccgcccacggtcgtggcgccgccctttcgaggccgtcgaccgtgccggacatgacggtccacagtgccccctcgcagcggaggacggtgcgtcagccctcgcgttccgggccgccccctcgcaggtcggcgtcggtgaggggctccaactcgccgcgggtgtcgagccggtagagcagggccacggcggggaagaccaggacggcggccacgacggtcacgacgatcagccagtgcagggtgctgggcgcccccgccgcctcggccaccgtcagccggccggggatcaggtacggacgctgcgccacgccccaggcgagtacggccgagcccatcaggacgacggccgcgggccgggaccacgctccggacgggcgcagcagcagccaggccgtgacgagcgtggccagtacggacacgatcaggaggacgagcccggcgccgtgggtgaggccgtgccacaggtgcggtgcgtccccgtgggcgacgatcagcgtgacggcccccagcacggcgaagacggcgagggcgaccagcgcccgacgccggaagtaggcgtgcaggtcgggggcttcgtagcgggtggcgtccgcggccaggaacaccgccccgagcagcgccgtgccgacgacggccagcaggccgaagaagacggaggtcgggttgaaccaggcgtgtgccgtcggctcggtgcccggtcccacccgccccgaggcgatcccgcccgcggcggcaccgaggaagaacggggtgagcagcgaggagaccgcgaacacggctccgtagacgcgccgcccggcgatccggcgggtgggcttgcgcagcgcgaagcccgcgccgcgcagcacgatgccgatcgcggcgagggccaggggcagccacatcgaggagaacacggtctggaagaactccgggaagccggtccacatgatgaccaggacgaagatcagccagacgttgttgacctcccagaccggggccatggcgtggtcgatcagccaccgggggcgcttcccgcgttccgcgcctcccgccgtcaggtcccagaagcccgcaccgtagtcggtgccgccggcgcaggtgtaggcggccaccgcgaggagcaggacggcggcgatcaccccggcggcggtcacggcctgccgtcccgggtcggtgccgcgccgccgccgtcacccggggcggggctgtcgccggccgcgacggcggagcgcgggccgtagggggtgtcggtctccggtgtgaccatcgcgcctgcctcggggctgcgttcgtcgtccaggcgccatcgggtgcgcatcttcaggagcacggccaggaaggagccgaagatgaagacgtacacgacgacgaccagcccgaacatggtccacagagagccggcgcgggccccggtcacggcctcggcgacccgcatgttctcgtagacgatccagggctggcggcccacctcggtggtgatccagccgcactcgacggcgacgacactggccacgccggcgcaggcggcgctgcggtagaaccacggcgaggcgggcagccggcggcgtcgccaccagacgaacgcgtaccagacggcgagcagcaggagcaccgagccgatgccgaccatgatgtcgaaggtccagtggatcagggtcgcctgggccaccgtgggccggtcggccgccgccacggaggacagcccgtgcacctcggtggcggggctgaagccggccaggatggagtcgagctgcgggatcttgatgccgccggtgacggtcccgtcgggatgcaggcggccgaagaggtactccggaacgtgcgtgtcggtgttccagacgatctccatcgccgcgaacttcaccggctgcttctggaacaccgcccgcgcgatggagtcgcccagcatgaactggatcggggtgaagaccgccgcgaccgtgaacgggacggtgaagcccaggcggtggtagcggtcgcggcggccgcgcagccagccgacggcgtagacgcccgccacgacgtatccggcggtgaccagcatcgccacgacgaagtgccagtactgcggcccgaacatcggcgtgaagatcgccttccagacgttcacgtccacggggttgccctcggagtcgagggagaagccccgcggggtgttcatccaggagttggccgccaggatgccgaaggcgcccagcagggccgtcaccggcaggggcagcccgagcaggaagtgcgtacgggcgggcagccggcgccagccgtacaggtagatggcgatgagtacggcctccaggaagaaggcccatgcctcgacgccgaagccgatcccgaacacgtcgccccaccggcccatcagacccggccacagcaggccgaactcgaaggacaggacggtgcccgtgacgacgccgatcgcgaactgcaccgccatgaccgccgaccagcggcgcgccagcaggagggcggtcgcgtcgccgcgccgcagcccgtagccgtgcatgatcagggtgatcagcggcagcgccacgcccagcggcaccaggatgatgtgcgaggcgagggtgaaggccatgagcgagcgggccggcagcatctgcggcggcgccgcctccgccagcaggtggagcgtggtgtgcatgcgtccctttccggggccgacacggaacagaggtcagccgccggtggcgaagcccgggaagagggtcatcccgccgtccacgtagagcgtggtgcccacgacgtagtccatgaggtcggaggcgaggccgaccgccgcgtgggcgatgtccgccgggtcgccgacccggccgtacgggatcagcttcagcaggtcctgctcggcctgctcggtgtcccaggcactgcggttgatgggcgtacggatcgcgccgggggcgatcgcgttgacgcggatcttcttcggggcgagctcctgcgccagggtctccatcatcatctgcacgccgcccttggaggacgcgtagttgacgtgcccggcccaggggatgatctggtgcaccgaactcatgcagatgatcttgcctgcggagctggagacctccgggacgacaccgcgccgcaggaactccttcgtcgcctcgcgggcgcacaggaactgcccggtcagattgacgtcgatgaccttctgccactgggcgagggtcatctcggtgaaggcggagtcccgctggagtccggcgttcgcgacgaggacgtcgatggtcccgaactcctcgaccatgcggtccatcatggccacgacctggccctcgtcggacacgtccgcctcgtacgccaccgcgcgcaccccgaaggaggcgatctcctcgacgaccttctcggcctcctcccgtccggccacgtagttcacgaccacgtccgccccggcccggcccataccgatcgccgtggccttgccgatgccggagttcgcgcccgtcaccagcgccttctgaccccggagcaggtgtgcggggatcacgccccggggtacgccctcggtggaactcacgacggactgcctccttcgcaccgccaccccgcgccgtcgggatgacggcaccccggcgggtccggcgtcacccaatcaccgcgtccggggcgcggcggcgagcagcgatccgcgttgcgccacccggcgcaggatcttcgcccggtcggcggtgtcccgcgccgggcgtcagcccatccgctccaggaggtggtcgccgacccgcagggcgttcgcgatggccgtcagggacgggttgaccgcgccgatgctcgggaagaagctcgtgtcgaccacgtagaggttgtccagttcgtgcgccttgcagttgaggtccagggccgacgacgccgggtcggtgccgaaccgtacggtgcccgcctggtgcgcggtggccccgatcggcatgcccttgtgcaggtagaggctgtggtccagcagatggtgctcgtgcatgccgaggtgccccagcatgctctggagcttgtgccgcagccgcttcagtccggccgtgttgtgggactcgtcgagcgcgaggtggatccggccgtcgccgtccagggtgacgcggttgtcgggcagcggcaggtcctcaccgcacagccagaagtccaccgcgtggtgcgccatgacctcgaagggcatgtcgggggtcacggccccggcccagcgcggggcctcgccgtggatctgctcggcgtccgacttgcccagcatctggatcccgccgaggggatagtcccagtcgtccgcgcccaggtaccagtcgtgcagcgcgagggtcttctggaactgcgtgtcgttcggttcccgggagacggccatcagagccaggttgttgtggcgcatgtagaaccggccgaccgtgtccgagccgttcgcgaggccctgcggatgccggtcgttcgccgaagcgagcagcagcgcagccgagttgaccgcgccgcaggccacgaccacgaggtcggcggagaaccgggcctcctcgccgccggcgaggcgggcgacgaccgaactgaccgtgcgtcctgtcgggtcggtctccaggcgcaccacgtgggcgccggtgaccagctcgacgcccgggtgcagcagcgcgggctccacgcagatcacctgggcgtcggacttgccgcgtaccaggcacgggaagccgtcgacccggttgcagcggatgcacacgctggacggggtcgcccggccgtcggcgtcctggtcgaggtcgaccccgatgggcaggtggaaggggtgcaggccctgcttctccaggtcgtcgctcaaccgctggatccgcggctcgtgttccaccggcgggtgggcgtactgggcactcgccggaccttccgtggggtcctcgccgtgccggccgtgcacccggtagaggtgctccgcctgggtgtagtacggctccaggtcctcgtaacggatcggccaggcgggcgagatgccgtcgtggtggcgcagctccccgaagtcctccgggcgcagccggaacagcgccgcgccgtagaacttggtgttgccgccgacgtagtagttgacctcgggcgggaactcgcggccgtgccggtcgaaccagaactcgggcgcgcggtacttccccttgacgaacaccgccgtggagtcccagttgtcgcgttcgcgggggaggaagcccccgcgctcaaggatcagcacccgctttccggacggggcgagccggtgggcgagcgttccgccacccgcccccgttccgatgacgatgacgtcgtagtgcggagcgtcgttcaaccggatcaccgtcctcgggctgcggtgccgccgcccggcgggccggtcgcggcagggtcccccttcgaacgtatacgccccccgccggtgcggcacccgggggccgcgcggtgccgcggagtcccctcacaggacggcgatcgggttcaccggggagccggtggcccccggcagccgcagcggtgccaccgtgcacaggaaccgccagcgcccgagcccggcgcacgcgtcggccagttcctccaggtccaggtagtccatcaggtgcatgcccagagcgtgcagagccaggacgtgcacggggaaggagacgccgggcaccgggctcggggccgtgtcgttgttgccgtccgagccgaggacggcgacctgccgctcggccagcagccgcatgcacgccggatgcaggcccgcccgcgagtgcgccgcgttccacgcaccggcctcctggcgccggcgccggtgtcccacccgtacgagcagcaggtcacccggcccgatccggacgccctgggcctcctcggccgccgcgaggtccccggcggtcacgaagtccccgggctccagccaggggacgccgcgcagccgcgggacgtccagcagcagcccggggccgacgatcccgtcgcgcaccaggtcgagggtgatcccgcgggcagcgcccgccgccaggcggctctccgggacgccgccgtggagctcgccgtcgaacacgacatgacacagcgcgtcgagatgggtgtgggcgtccccgtgcacgttcatggcgaaccggtccagcgcgaagtgcacccccggagttccggtctcgggcggggtcggcgcggtcagacggtagacggcgggctgcggatcgtccggtcccggctgcgtctcgatgggcgcggccagcgacagggtgcgcccgtgccgcacgtcggccgcggccgcggccacgcgcgcgggggtcaggtgggcgagggctccgcgccggtgctccgcgccgtcggacgcctgacggagcagctcggagtggagggagcggaaggccgcctccgtcatgaaaggcgacaccgtcccgtcgggtgtcgggtcgacgtccgtcacgcgggtcctcccggtctgccgaaggccccgcctccactgtccgccgcccccgcgccgcgtgcatcccggcgccggggcggcggccgtgccgcgctccggcgccgcgacgaggtcgccgtcccgccggaccgcggcgcccggcatcctcaggggcggtgtccggcgaccgaccggtgcgccaccgggaagtcgaagtacgtgtcggggaacagctccggcttgtgcgtgaagtgccaccactcctcgggcaggttgacgaacccctccgccgtcagcgccgacctcagcaggtcccggttcgcgcgctgtgccccctggacacgcggatcgtccgtgtgcgacagggtgtcgaagcagtcgaagcccgtacccatgtccaccgagttgtccgggtaccgctccgcccggggtgcgaagcagggcaccgacgcctgcccgggccgcgggcggggcgccggaagcgccggcagccgcaccagcgacacgtccatggtgctgccccggctgtgtcccgacttctccgcgatgtaaccgtccgcgaacagccgggacttgtcgacgcgcggatagaactccgccttgcgccgctcgtcgccgaggtcctgcgcccaccgtacgaagtggtcgacggcccgctgcggccggtagcagtcgtacaccttgagcgagtacccctggcgcagcaggttcacctgggcccggtgcagggcctgggcggcggggcgggtcaggatgcagaccggctgccggtagccgtcgaccgggtcgccgacgaagttgtgcggccgcacgtaccgcatctcctgcaggatcgtcgggtcgaccgagctcagcgccacgaacgcgctcggcgccttcgcctccggtgcgggcgcgctcgccccggcggtggctgccccggccatcgtgagagcggtggcggcggccgtcacggccacggcgaggcgtgccctcatcggcggcaaggacgtggaactgctcatcgaaccctccatctgcggcgctgcggacgtgatcgccaccatgctgcccgacgccgggtccgtcccggtccggtccggccgaactgcgcccgccctggtgcggacctacgctgaacgggtgaccggccgcgcccggggagcggtgacgcccggggagcggtgacgcccgccccgcccgggagcagcccgagagaggtgatgcccgatgtccggaccccggacggcagcggcccgctgcgcgaccgccggagccgcctgcgtgctggtgtgcgcgggcgcgggctccgccggagccgatgacaacggtatggccgacaagagcgcccaggccatcgcccaggcctcgcgcgaggccatgaacgggctcacctccatgcgcatggtgggcaaggtgaccgacacctcgggcaccaccgccctcgacctccggttcgacgagcagggcaactgcgtcggcaccgtcacgcctcccggcaacgcgggaacggccgacatcgtcaagcgcggcaacgacgtctggatgaaactcgacgaggacctgctcagatcccaggtaccgggtcccgcggccgacgacgcgatcgcgctcatcaacggccgctacctgcacggcaccacggacagcgccatgctgagcgatttcgccgacgtctgcgacctgggcttcttcaagaaggagttctccgcgaagtcgccgggcgaacagctgaccaagggatccgagaccaccgtggacggacagccggccatcacggtcaccagccgcagcgccgccgggacgggcgtcttccaggtctccaccgaggacgagccgtacctgctgaagctccagggcagcgagaagtccgggcagcgggtggcggccaccttctccgacttcgacgagcccgtcacggccaagcccccggcgcccgccgactcggtcgacctgtccgagctccgatagcggatcagcccggcgccccggaggctgtggggcgtgccaccggtcacacccgcacccgcacccgtgcctcagcgcagctggcggcggaccaggccgtggaagaggccggtcgtgtcggcgagcagctccgcgggcgcgccctgctggacgatccggccctcctccatgacgaacacgcggtcggcgtccatcaccgtggagagccggtgggcgatcaccagacgggtggtccgcagggcgcgggtggattcgatgaccacgcgctgggcctcgttgtcgagcgcactggtggcctcgtcgaggaacaggacgcgcggcttgcggacgagggcctgggcgatcatcagccgctggcgctgtccgcccgagacggtcccgccgccgtcggacaggatggtgtgcatgcccatcggcatggccttgatgtcctccgccagacccgccatcgcggccgcctcccaggcctcctccaaggagaacgtcccggcgccccggatgcagtcgaggatcgagccggtcaggggctgggcgttctgcagtacgacaccgcactggcggcgtacggccgcccggtcgagcgccgccaggtcctggccgtcgtagagcacactgcccgagacgggccggtcgaagccgatgagcagccgcagcagcgtcgacttgccgcagccgctggccccgacgaccgcgacgaactcgcccggcccgatgcggaggctgacgtcgtcgagcacgagcgggccgtcgtcggcgtagcggtaggacaggttcctggcctcgatggcaccggtcagctctcccgggcgggtactggagcggtccacctcggggatctcccgcagcaacggccggatctgctcgaacatcggcagcaccgaggcggccgagacgagcgccccggtcacctgcgtgaccgacgacagcagcatcgtcaacgcggtgctgaacgtgaggaactcgcttgccgacatggcgccgcgggccggaccggccagcaggacgaacatcaccagggtgcagagcgggaggcagacggcgccgaggaccgtgaggacgttctggatgcggccgatgcgctggtgcaggtcccgggtacgggcgaactcccgggcccaggcggcgtacgcgaagctctcggccgcggcgacgcgcagcttgggcaggccccgcagggtctggaaggcctggttgttcagccggaggccgagcgtgttcagccggcgctcgtaccgcagctgccacagccccagccccaggaagaccgccccgacgacgaccagcatggccagcgccgcgagcgccagcggcatgctgtggacgagcagcaggacgaggctcaccgcgccgaccgcgcccgcctgtacgcagaccgggccgatgccggacagcacgcgacggatggcgctgatgcccatggccgccccggccagttcaccggtggagcgaccggcgaagaacttcgcgggcagccgcagcagccggtcccacacggccggttgcaaggtggcctcgacacggccctccacgcgcaggagcgaggtgttctgcagcagcatgaagacggccgagaccacggcggtcgcgaccagggccaccccggtccgcacgatgagcccggtctcgccctgcgggacgtaccggccgaggacccggccggtggcgaccggcaccagcgcgcccagcaccaccgcgaccagcccgcccagcagcaggctgcgcagctcggggaaggtgccgcgcacgctgaagcggagcagcgcgaacaggcccacccgcccgtcgggcagggggcggtacagcatgacggcacgcggttcgaaggcggcctcgttgcttctgccgacgcgctcgcgcccgccggtggcgggatcgacggcctcgtagcggccgcgccgccacagcagggcgaccggcgcgccgtccttctcgcgcctgcccaccagcggaccgcagttctcccgccaccagcgtccgccgagccggaccgcgcgggtgcggatccgggaggcgagcgcgatgcgttccacggtgtccagctgctcggacggggtggcgacctcgcccggtggggacagggcgatgccggccgccccggcgacgaggcggcacgcggcgaaggccgcgtcggcgctcccgttccggtcggcaccgcgaccggaacggatgatggacgccagcagcgtacggtcggcctgggtgcgggccgcccggcccgcctcgatcccggcggcggtccggtcctcgtgcgcgcgctcctgctgttcgatccagccgtccagggcgtacagcagccggtactgctggtcgaccatgccctgccacagcgccgcgtcgacgagaagggtgcccaccgcctccgcctcgtacacggcgccgtactgcacgctgccggggacgatccgcatccacaggatgtcctcgtcggctccgccgtgcccgccggcggcggtggccgtgacggtggccgcggcgtccagcggtgcctcgtagagcacgcgcagaccgcggccgatgccgcgcgcgaaggcgtcctccagcgggctcggccggcccgcggcggtaccgtactgcccctcgtcggcgtaccacggtccgccctggaaaccgccggcgtactccgggtgctccggggactccggacggtagagctcccgcagggctatgcggcgcagcaggcacccttgcaggggccggccgaccagggtgtggtcgggtccctcggccggaccgagcagcagcgtgcccggctcgagccggcccaggaagtgccagtgcccgccgagcgcggcgtccacggcgaacaggtccagctcgccctcgacgaccagccacaggacgagcgggccttccagggacaggctgcgcacgcccgagcagtcgaccggcgcgcccaggccgcccagagccgcgacgaccgggtccggcaccccgggcggcggcccgccggagccggcggaagcggccgtggaagcggcagtggcggtgtggtgcgcgtaggtcacctcagtgctccttcaccagtgcggcgtacgggccccgcgcggcgatcagctgctcgtgccgcccgcgttccacgaccgtgccccggtccagcacgacgatctcgtcgctgtcgcgcaccgtgctcagccggtgggcgatgaccacacaggcacagccgcggcggcgcaggttgtcgatgatgatctgctcggtcaccgcgtccagggcgctggtcacttcgtcgagcaccatgacgctgggacggcgcaccagcgcccgtgcgatctccaggcgctggcgctggccgccggagaagttgcggccgtcctgctcgacgcggctgtggatgcccccggggcggcgggcgaccacctcgtgcacggcggcgtcctcaagggcggcgacgacggcctcgtccgcgatggaggggtcccacagcgtgacgttgtcgcgcacggtgccctcgaagaggaacacgtcctggtcgacgaaggagacggaagcggcgagcgccccgcgcgggatgtcctccagccgcatcccgtcgatgcggacggccccggcccagggggcgtggaggccggagaccagccgggagacggtggacttgccgctgccggagcccccgacgagcgcgacctgctggccggggccgaccgtgagcgagaagtccttgagcagcggtgcgtccagcgggttgtagccgaaggtgatgcggtccagctccacgtggcccttgaggcgccgggtggaggccgcgggctcgcgccgcgagtagacccggtcgaccggaaagttctcgacgtcgtccaggcgggcgacgtcggccgcgaagtcctggatccggccggcgacgccgcccagccgggagatcggggcggtgaagctggtcaccagtgcctggaaggcgacgagcaggcccacggtgaggtggccctccaccgcccgcaggccgccgatcgtcaggatgagcgcgctgttgaacgccgcgagcgtgggcgcgacgatcgccagccacgcgctggggacgccgagccgctgctgcacgtcgagggtgaccgcgtgctgtccggcccagcggcggaagaagccgttctcgccgcccgtcgccttcatcgtctcgatgagctggagaccgctgtacgcggtgttggtcagccgggcgctctcggcccgcagcttctgggtaccggtggcccgcagccggatcgcgatccgcagggcgaccacgttgagcagggccacggccacgccgacgagggtgagctggggatcgtacgtccacagcagcaccgcgtagaggacgaccaccacggcgtccacggccgcggcggacaggtcccgggcgagggtctcggcgaccgcgtcgttggactgcaggcgctggacgaggtcggccgggttgcgctgggagtagaaggtgacgggaagcctgagcaggtgccggaagaagcgggcactgcccagggtcgaggagatgacgcgcccgcgcagcagattggcctgcagcaccgcggtcagggccgcggtgagtacgagggcgacggccatcgaggcgaacagcaccccgagcagggaggtctgctcgccgatgaggaacatgtcgatgtaggtacggctcagggccggcaccgtgacgccgacggcgaccaggagcaggctcgcgaccatggcggcggccagggtgccggaagtgccgcgcaggcgggcgggtacggcgcccaggacgcccggcctgcggccaccgcggcggaacccgtcgccgggctcgaaggtgaggacgaccccggtgaagctggtgtcgaactcctcgatgggcacgaaccggcggcccttggcggggtcgttgacgtacacgccccggcggccgagccgccgggccgtgccctcgtagacgacgtagtggttgaactcccagaagagcacggccggggcgcgcacctcggcgagcgcggccaggtccatctgcatgcccttggccgtcagtccgtacccgcgggcggccttgaggagactgctggcgcgggagccgtcgcgggagacaccgcaggcgatgcgcagttcttcgagcgggacgaagcggccgtggtggccgaggaccatggccagggcggccgcgccgcattccaccgcctccatctgcagcacggtgggggtgcgtacggggcggggcgtcctgccccggggtacgcgcgggggcgcgggcgcggtcctgcggcgcgagccgcccccggacccgggctcggggcggtggcgccggcgcccggtgggacccgggtgcggcgcggtcacggcagcagccagtcgaccgggcgctgcgcggcgaggtggatggcgccggtgaccggcgtccgcgaatcgacggcgtacgggggcccgtccgcggaggaccaccggtatccggagggcgtggaggcggagcggtcgaggcggacgacgacggccaccgggctgccgtggcgggagaactgctcggcgagccccccgtcggcgaggaagccgccgatctgcgcccgcgtcaggggcgcgcggcccaccgccgtgacgcgcccgcgcagcgtgccgaaccgctgctgcgggacggactggaggctcaggtcgaccggggagcccacggcgacggccgagccgctgccgcccggcacgtacagcacggccaccagcgggtcctccggatcgcgcacgcgttccacggtggccacgtccgcccccgtggcgacgaccgaaccgaccttggccaccagcgtcgtcagccggccgccggtcaccacgcgcacgggccgttccccctgctccgtacggacgttgagcaggggcgcgccggcggccagcaactggccctcctcggcgaggactccggtcacctgtcccgcgaccggcgtctgcaggacgtaactgccctcggcccgggtgaggatgccggacgcgctcagcttggaggacacggtgccggtgaaggcccagtaggccgcggccgccatgacgacgaccgtgacggccaggacgagtcgcccttgcgggcgggcgaagcgaacgggcaggtccaattcctcgggcgattgcagcttggaaagagccttttggcgaaactgcacgaactgttccttcagctgcattcgtatcttcgggcggacatgcggatgcccgcgaaccccggagccgtgggggacgctccggggttcacgggtatttccggatcagagaccggcgcgaccggcgttcaccgaaacgccggtgatgcccgtgacgaggccggggacgtgggacacgatgcccgtcgcggcctggacggtgtggagggagcccacgacgcccacgacattgttgacatcgctggtcacagcgccggccaggccgccggacacgctgatgatgccaccggacacggcgtccagctcggtgtcgtcgatctcacgggtctcaaggtcgttacgcatggcgcgcacctttcatctggggggaggaattcatcgccgagcggtgggcggcgtgaaactcggccgccgttcccgactgctgcgatgcgaatgatgaaagcacgcgaacgggccgcccacccaatcccgttgacttcccgtcacgggtggacagccgtctccgccgacggacgtgcagcttgattcaccgaatggtggcgacttcttcacagaatcgagtaacagaaatgggcagtgcggtccttacatggcacctaacgggatgaaccatccctaaacggatagaccaaagcgcgacaaaccgccgtgtgggggaggttggctgtcgagatcgcggacgcgatgtgcaggtttcccgggggtgctcagggtgtcgggcccgtcacaccgggtgcgcccggaccccgcggctacgggctgacgtcgtccacgagttccgccagtgccgccgccagcgcgacgaggccggagccggcgggaccaccgggctcggacatgtacacgtcgcggcggatctcgatcatcagcgcgccgacccgccggtccctggcgtagtggtcgagcggcacgtacgtaccggcgaaggggctgtcgagcccggtgccgccgaagcccgcgaaggccttctcggccgcggcgaggaggccgggcggggtgtggaaggggtccgtgcccaggcagatcggggggcgagggccggcgccgtgcagttcgtacgggagcggctccgacgggtacgagtgcacgtcgatgatcacggcgcgcccgacggtctccagccggtcacccacggcccgcgccatcgcgtccgcgtacgggtggaagtagcggtcgaccaacggccggccgtcgaatccgtcggcgcgcaggcgctcgcggtgggtggtgcgcgtgtacaccgctcccatccccacggccagcatctcctcgcgctcgtcggggaagcgctcggggtcgacgacgaggcgggacagcccgttgacgaaccgccacggcgtgacggcggccgcggccgaggccgccgcggcgatgtccgcggtgtgggagtcggtgatgtggtcgagctcccgctccagctcccggtcgtccaggaggatgccgccgcggacggactcgggtatgacgcgcgaggagtgcggtacgtgcaggatcaccggcgacgtgccggcgccgggcaggatccggaagggcgcgggcgcagggttcatgtgtggtcctcggtgaggcgggtgcccgtgagggcatgaccgccccatcctcccggcgcggggccggaagtcaccgttccgttcgccgcccggagacctgtgtcccccgggtgccacaccaccccgcgccggccctgcgcgccaccgcggtcaccgggtctcggcggtcaccgggtgtcggacgccggcagtgcctccaggaccctcttgaggttgcgcagggtggtgcggatgttcccgcgctggaagtcggcgaaggtgtgtccccgcgtcgcgatccggtcgaaggcgtgggccacgaagtccggccacgcgcgccggtcgtcggtccacgtctcggtcacccgggtgccctccgggaccggctcgaaccggtactcccaggtggcgatggagccgggcacccgcggccgccggatcccgatggcgtgcacccggaaccggaacagccggtcctgttcgaccgccgtcaccgtgcaccgggtggtccagcggaaggcgccacgcttgttccgcccgtcgaagaccgtcccgacgcgggcctccccggcgcttccgcgcacggtggcgccgaggttctccggactccagtcgcccatccgggtgggatcgcagacgtgccggaagacgtcggcggggctgacgtcgacgatgatgctgtcggacacggtgaacgtacgaggcatggctccccctctcggcggccgacgctaccgtgcccacggccccgtggctacctctcggtaacttcaggggccgggagcacggccgaaccggctactgccagtcgtcccacggcgggggaggcatctcgtcgaggtcgaagggcggctcgtcggggtccggagcctgcgcatgggccgacgcctccgcacgggccggcgcttgcgcatgggccggtgcctccgcatgggcgggcgccgaaggcgcgggccgggccgccgggggagtcggcgccgcgccctcggactccgccgggggagaggccgccgccccgcactcggccagggtgtcgaggacgccctcggcgtacttggcgagcttggcctcgccgacgccgccgatggtgcccagctcctccgccgtggcgggcagccgcgtcgcgatctcccgcagcgtcgcgtcgtggaagacgacgtacgccggtacgccctgctccttcgccgtctcggcccgccacgcgcgcagggccaggaacaccggttccgctgcggccggcaggtcgacgggtacccgggcgcccttccccgagcgcgatccggactccttgcgggcggggccggtgggggccttctccttccgcatcgggacgctgcggcgtccgcccagcacctcgccgctgtccggggtcagcacgagcgtcccgtactcgccctccaccgccagcagccgctgcgccagcagctgccgtacgacgccccgccactcggcggtgctcaggtccgcgccgatgccgaacaccgagagcgcgtcgtggtcgaactggatgaccttggccgtcttcttgccctggaggatgtcgatgatctggccggcgccgaacttctggcgccgctcgttcgccagccgccacacggtcgacagcagcttctgcgaggcgaccgtcgcgtcccaggactcggccggcgtcaggcaggtgtcgcagttgccgcacggcgtgcccgtctggccgaagtacgccagcagccgcacccggcggcagtcgaccgtctcgcacagcgcgagcatggcgtccaggtgcatgcccagggagcggcgatgcgtctcgtcgccctcggaaccctcgatgagcttgcgctgctggaccacgtcctgcaggccgtacgccagccacgccgtggccggctcgccgtcacggccggcacggccggtctcctggtagtagccctcgaccgacttcgggaggtcgaggtgggccacgaagcgcacgtccggcttgtcgatgcccatgccgaaggcgatcgtggccaccacgacgaccccttcctcccgcaggaagcgcgcctggttcgccgcacgcgcccgggcgtccatgccggcgtggtacgccacggcgtcgatgccctgctccaccaggaaggcggccgtcttctccaccgaggcccgcgagaggcagtagacgacccccgcgtccccggcgtgctcgctgcggatcagctccagcacctgcttgagcgggttgttcttcggggcgatgcggtattggatgttcggccggtcgaagctcgcgacgaaatgccgggcgtcctccagaccgagccgcgccacgatctcggcgtgggtcgcctcggtggccgtcgcggtcagcgcgatccgcggcaccttcggccagcgctcgtgcagcatcgacagcgcgaggtagtcgggccggaagtcgtgaccccactgggcgacgcagtgcgcctcgtcgatcgcgaagaccgacaccttgccccggtcgagcagccgctgggtgctctcggtgcgcagccgctcgggagccaggtagagcaggtccagctcgtcggcgaggaaggcctgctcgacggcctgccgctcgtaggggtcctgcgtcgagttgaggaatccggcccgcaccccgagggcggtcagcgcgttcacctggtcctgcatgagcgcgatgagcggcgagatcaccacgcccgtgccgtctctgaccagcgccgggatctggtagcagagcgacttgccgccgccggtcggcatcagcacaagagcgtcgccgccgccgacgacctgctcgatgatctcctcctgctcgccgcggaaggagctgtatccgaacacacggtgcagaacctgcagagcgtcggaggattcgggggaggtgtccggaagtgccatccgtcaagcctatcgacacccacggacaccggacccggcatcccgggatggcgaggccatgacaccaggggtgagcgaagcgggccgcctcacccctggcgggcgaggcggccgtcgccctgtcgggcgcgatccttcgcagcccgcacgcctgcccgtcgagccgctgtggatccgccgcatcacaccgtggctgctgggcgtggccgtgatcctgcccgccctgtccgtggcgaccgagctggcgatccggccggacgacgacgacctcaggcgcatcgccgcgatacagaaggccggcgccgaaaccgccgagggcacggtcgtcagcgtcgggcggcggacgtgggacgacccgaaggtggcgcgttctccctaccgccccatctcacggtggccgccttcgttcccggcggcctcctgctgtacatctgggcgctgcgcgtgacctggtacgccccgaaggccgacgccgccgcccgtaccctccgcgagctggtcagaggccgggtcggggcttcggcgtagtcgcttgatacgtctcgcccgccgcacacggcgcggcccgacacgtcgccgtcgatacggcccagcggtagtcgtaccgtcgattccgcacacgtgcatcgcttcgggaacggcggatcgggccgtacgccaaggcgctccaggccacagggcggggcgtcagcgatttactcgcccacggactcgctgcacagggctccggcacccttgtcagcaccgcagctccgccgcgcgatcgcacatcacctccacagcgtcaggcagtcgaggaagcggcccggggtgggcttcccggatgagtttcaccgcctgaagctgccgaccactcctgatcagctcgtccacctcttcccgaaccaccggcggcagcgcatcccagatcgagttctccatgcgccgatccaagcaactcaccctctcccaccaccaccgaattgaacgccgcgaccatgtcgaagccctgggagtcggttccttgtccgtcgactacgagggcgcctcgattgccgaggtccaggacctcacgctcgtcggtgacgtgctcaccggcttgctgccacagccgacgtacgtggcgagggcggcggctttcggacatttcgcgccgatgccgagcggagaggcacgtgcgcggctttcgggggcaggcgagggtttgttccgtagccgcacgccgtctccggccgaacgaccgaccgggcggcgttccgttcaaggaggtttcgtcatgttgatcagtgtcatccgcacaggcgggttcgcgggcggggagcggaccgcttccctcgacacacagtgccgcgccgacggtgcagagcttgagcggctggccgagcgcgcactcagtggtgaggtccccgcgggtccggatcccgtgccggacgcgttcagctatgtcctccgggtcgacggcaagctggtggagttacaggagccctacctcaccgaggaccagcggcagctgatcgacgtggtcatggccgaagcggtctgagagagcggtggagcggtgccgtaccggcccgacccggggccggtacggcacaggcggccgggccggccgtagtccacggcacccgcccgtactccgccggtacatgcgggcccctggaacgtcctcacggccgaccggcagggctgcgtagggaagccacgggccgtcgggaccgaccggaaccgagcactccctgaccggcctcggcgtgaagtccggtgcctgaccggcagtgtgcggttccgcctcgccgctccgtccgtgaggcccggggcccgccccgggccttcagccggacagcaactcctccagggccttgtcgagatcgaggaactcctctccttcgccgacaacggcgtaagtccggtccaggaaaccttgcagcgcgccggcatccgcacacagcaccgcaggttctgctccgccgtcgccgtggttgcgcaagccgatgcggacttcgtcgccgcccgcccccctgcgcggctggaaggtgacgtctccttcacccaccggccgccgcgccccctcggccagcatctgccggtcgaactgccaggaagccaggacggccagaccgtccaggaagtccgccttcaccgcgtacgggttgtcagcagagtacgaaaaccgggcgaagagcggcacagcagcctctcccgactcaagatggaccgcgatcagactggacacgcacgacatgagggaagcctccggattaggcggtacgacgcgtccctcgtgtgccctctcccgccgtactcacgccggagcgacggcccggaccgccgggctgcgcgggttcaccggctcggcgagcccccgccgccccaggtctcgtcggggtggcccctcatcgagggcggcgtacagccggcgtcctcaacacccgcgccgcagctgattcggtcatgacagcgcgagtcagtcggcggtggctgggcacatgcgcatgcatggaagcagatgaggcgcacttcacacgtcctgcccccgcctccgccccggcccggtcgaaggccggggccgtgcagaagccaccgcagccacagaagccacagcagcccaacggccaccgtgcgaagcggtccggctggacgaacttcaccggccgactgcgacggcgtctcctggcctaccgggaggtggagttcctctccacccgcattcccggggatccgggcgccggggaggagtgtctcctcctggtccatgtccgcacgatcgtgggccgcgtccactaccggatgtgcccggactgcgcgcgggccgtcatcaccggcatcgtcatcgaggagcgcttcctcgcggcgggcctgggcacccgggccctgtctcacctgcgctcccgtcaccccggcatcacctggggcagcaccctgagcctgcgcgccacccgcgatctcctgcgccgcatgcggatcccggcgatgtcagccgtcccggtgtgcagccacatgccggcagcgtcggccgccgacggcccgtgatctcggtcaacggccccgcggggcgggggcgcgtgcagtcgacgacatgtggagcgaccccgaaggcactgccgcgcgctacgagcggatgagggaggggctcggtgcttcccgagagtggtgccacccgacgggtcgccgcctgccgtcacaccctggcgcaaagcccgttggcggtggacgtcttgacggaggcgtggcaggcgcaagcgcttgcccaggcgatcggggcgacgccggcggtcagcggcccggccggcctgcgcgccggggcgcgcgacctttcccacaccgcgggccgaggaggtcgggtcgacgaccgggacgcggccgcccgggccacctccgcaccgagggcggcgatgctgaccgaggtctcggaccccgcgcgcactctgcgcgccctggccgcgctgctcggcgaagtcggcatcgcacccgtcgcggtcgcgtgtgtcaccgacgacgaacacgtctactggcagtgcatcgaggccatcgacgcggccgacgagtcttccggccgggtgcgcgggctgttgcgcggcctcacggtcccggagggtgaagcacgcacacgggggccggccgcgatggaatcgcgtgaatagcggagcgatgaaggagagttggaatcggccggccccgtacggagggcgggcagccagggtgtggcgcgtcctggctggtcggccgcgccgtgcccagactcggtcgggcggagccatccgcccggaacgaggagtggggcaggtatgaggaacgagagcaaggtcgtggccatcaccggagccagcagcgggatcggggaggagacggcccggcggctcgccggcgacggccaccgggtgttcctgggcgcgcggcgcaccgatcggctggacgcgctcagccgcgagatcggcgaggcgggtggtaccgcggccttccggcggctggacgtcaccgacgccgccgatgtacgggccttcgtggctgccgcgcggaagcgctacggccgcatggacgtgttggtcaacaacgccggggtgatgccgctctcgccgctggacgcgctggaggtcgacgagtgggaccggatgatcgacgtgaacgtacggggtgtgctgcacgggatcgccgccgccctgcccgtgatgcgcgcacaaggcggcggacacttcgtgaacgtcgcctccgtcggcgcgtacgaggtgtcgcccaccgcggctgtctactgcgccaccaaattcgcggtccgagccatttccgagggactgcgccaggagtcggacggctccgtccgggtcactctggtctctccgggcgtgaccgaatccgagctggccgaagggatctcggaccctgccgcgcgagaggccatgaaggcctatcgcgccgtcgcgctgcccgcgtccgccatcgccggggccgtcgcctacgccgtcgcccagccggccggggtcgacgtcaacgagatcgtcgtacgtccggccgcgagcgcgcagtaaccgccgggcgcggcgccgggccgtcggcccagtggtcgagttcggcctggacgcggcggtccacggccagcgagagctccgctctcaccacgtacgtgaccagcggatgcacgctcttcagcgcggcggcgagccggcccgacccgctcgggaccgcctcgccgccgatggtttcgagcaggcgggtgcggacctggacggtgaagaggtccgcgagcgcgtcgacgtgggcgcggacttcgcggccggcggcccgtacggcatcggcgaggtcctggggcatcggctggtcctggggcgtcacctgggcccggacgtccgcgtccccggcccgggggtccccggcccggcggtcccggctccgggaagccaggcgagagcccccgccccgggaagcccggccccgaggttccccgcttcggaggtccgtgttcccggagcgggccaacgagctgtccagtcccaggagttcggcgacggactccaggttgcggccgcgcccccaggcgtccatcagctcggcgatgccgcccagtgtgtgcccgcgatcgagcagggcggcgatcgtccgcagccgggcgaggtgggtctcggagtaccagccgatccgaccgtcgcggcgcggtggcggaagcagcctgcgctcgcggtagaagcgaaccgtgcggacactcactccggcttcctcggcgagttccgcgatccggaattcccggcccccgctccgcgtatcgctttcattcgtcatggcggcagcctacgagttctccggccggaactctgccgcgagagcgtacggaatgttgaattccggagcccggtaccggactcgggtttacaaataacggacaccgaaccggttcggggaaatcctgatgtgcgaacccacagccgacgcccccgcggtccgtggcttcgcattaacgctgtatttcgccgttgacgatggttccaacaccgtgatcaactgctgatgtctcgccggggggaggtgcctgtcatatggccgcgcggtgcgcttcacagcggtaccctccagcagccgtctcatcgataggtgcgttcatgtcattagcggagatcgcctgtgccgccgagtcacccaagtcggaaccaccggatctcggcatgctcatcgacccggcctcccggccggatccctatccgatcctcggcgccctgcgggaggcctccccccgcgccgcgtccgacggcctggtcgtcgtcggccggtacggggactgtgcgaaggtcctgcgcgacccgggcatgagcagtgagcacgaccgttcgaggctggccccgcggcgcggcgcccggcccatgcggaccggcaacttcctgcacctcgatccgcccgaccacacccggatccggcggctcgtcaccaaggcgttcacgccgcgcgccgtcgccgcgctcgagccgcgtatccgggccatggtggacgagctgctgaccgcggcccgggaccggggatcgctcgacgtggtgaccggactggcccatcccctcccggtccgcgtgatctgcgagctgctcggcgttccggcggaggaccacggccggttccaggagtggtcggccagcctggccgaaacgctcgaaccgccccttcccggcctggtcggcccgcgcgccaaggtggcggcggcacaggcacgcgccgagttcatcgcctacttccgcgagctgatagccgcgcgccgggcggtcgcccgggacgacctggtgtcccatctcatccaggtcaaggaggacggcgaccagctgaccgagagcgagctgctggcgacctgcatcctgctgatcaacgcgggccacgagaccaccgcgaacctgatcaacaacggcgtgctggccctgctgcgccaccccgaccagctccggctcctgcgccaggaccccgcgctcgcgccggccgtggtcgaggaggtgctgcgctacgacaccccggtgcagctgacactgcgcgtggcgagcgggccgacccggctcggcgacgcgcacatcgagaccgacgacctggtcgtgctgctgctcggcgcggcgaaccgggacccggaggcgtacgaggatccggaccgcttcgacatccgccgcaccgccgcccgcccgcacctgtcgttctccgccggcccgcacttctgcctcggtgccggtctcgcccggctcgaagcgcgcatcgtcttcgaggtcttcgcgcgccgtttcgtcgaacctcggctgtgcgccaccgaaatcgcctacaagcccaatctgaatctgcgggggccggcccggctcgacatcgaattcgacgccgtgtgaccgcgggccccctgggccttacgcggccgggtcgccgttccgccgtttgatttccacctttcactttcactttcaccttcacgatttccttttctttcctttcctttcgatcacgtcgtggtcggcgtgtggcgatgagtcatgcccgcattccgcccgcgcatcacagaacaacacaacgcaacacaacatttcatgagctgggggagctatggaactgtctgccatgctgggctgtccggagaaagcgttccgcatgccgcagggcgagtgggaagagtccgtgacggccgccctgcgcgaatccttcgcgctccattccgagaagaacgccttctaccgcgcccagtgcgaggcggcgggggtcggcccggacgacatcggtaccctcgcggatctggcgaagatgccgctgctgccgatgagcatgttcaagaacccggacgcacacgtcctgctgaccgcgtcgctcgccgacgtggagctggagatccgcagtaccggggacagcggcgtgcccagcgtcgcgcgacgcgacgcgacgacgacgacccggatgctctcggcggtcttcgcccagtaccgggagttcttcggcatctccaacggcgcggggctcttcctcagcccgtccgcggtcgaggctccggagatgggcatggtcaaggccgccgtggtcctcaacggcctgctggaccaccacgcgtacgtggtgcgcgactacaccttcgacccggaggaggccctcggcctcctgcgcacctggggcgagtcgatgacccggcacatcatcgggccgccgttcctgatcacccgtctggtgcaggccctcgaggagcagggcagcacgcttcggctcgaccccgactcgatggtcatcacgctcggcggatggacccggtacacgggccagaagatcgtccccgcggagttctacgagcagctcgaccggaccctcggcgttcccgccgaccgggtgcgtgacatgtacggaatgatcgagtccaacatgctcgccgtcgagtgcgagcaccaccgcaagcacgtcccgccgtggagctacgtgagcgtccgcgacgtgacggacacgagcgtcgaggtggcgccgggcaagacgggtgtgatcgccaccctggacgccctcaacacggcctacccgggctacgtcctcttccaggacgtcggcgaggtcgacgtgtcgccgtgcccgtgcggccggaccggtcagaccgtcaccttccggcgccgcctgcagggcgcggagctcggctgctgcgcggtcagcatcgagaagttcatcgacagccgggagatcgtcgccgagtgcgaactcccctccctcgcacctgtggagggctgagccgtggcccgcttcacccccgtggtcgtcgaccacttcaccaacccgcgcaacgccggcgagctcgacgcccccgatgcccgcgccttcatcggcaaccccgtctgcggcgaccagatcatgctcaccgcgcacgtcgccgacggcaccgtgaccgaggcccggttccgggcgcacggctgcgccgcctcgctggccacggccagcgtgatcaccgaggcggccacgggccgcccgctggacgagctggccggctggaacgccgagcacgtcgaggaactgctcggcggtctgccccccgcccagcgacacgtggcggcgctgggcgccgacgtggcgcgccgcctggtcaccaactaccaggagggaacgaacgatgacatcgccctcagctgtgcgtagccccgaccagtccgccgacggccggccgggcatctacctggacaacgcggcgaccagcccgctgtgcccggaggccgtcgaggccgtgctgcgcggcatggagatcaccggcaacccgtccagccgccacgcggccggcgacgccgccaaggaggccctggagtcctcccgggcccagctcgccctgctgctggactgcgctcccgaggaggtcgtgttcaccggcagcggttcggaggccgacgcgctggccatctgcggaacggtgctggccgccaagggcgcgggccgcccggtccacctgatcaccaccgccctcgagcactcggccgtcctggagtcctgccagctggcgcgcgaactgggggccgaggtcacggtggtggcacccgacgcgcgcggctgggtcgacccggagtccgtacggcgggagctgcggccggacaccgccctggtgtccgtcatgcacgccaacaacgagaccggtgtgatccagccggtcgcgcagatcgccgaactcgcccaccgggccggtgcgctgttccacatggatgccgtgcagtcggcgggcaaggtgccgctgaccggcatcggcgccgacctggtgtcggtgtcgggccacaagttctacgggcccaagggggtcggcgcgctcaaggtggcccgcggcgtcaccctggcgccgctggtccgcggcggcagccaggagagcgggctgcgcgcaggcacggagaacgtgcccggtgtcctcgggatggcggcggccgcggccgccgccctggaacacctcgcggaacccgggcagcgggaacgccgggagcggctgcgtgagcgcctgctcgcggcgctgtccgcggccggcggcgtcgaggtcaacggggccggggcgccctgcctcccggacaccctcaacgtctccttcgccggcgtccgcggcgacaccctcgtcgatctgctcgccctgcacgacgtctacgtctcggccggctccgcctgccacgcgggcagcgacgagccctcgcacgtcctgaccgcgatgggcgtccccgtggcgcgggcccgggcggcggtgcggttcagcgcgggccgcttcacggacgagcgggcggtcctgtcggccgcggccaccaccgtgggcctggtcgaccgccttcgttcgctcggcccctccctcgtaccgaacccgccgcacaccgaggagtccctgtggtcgaccttgcactgagccctgaccagcaggccgtcgtggacgaggcccgcgagatcgctcgccgctgcctggccccgcgggccaccgagcacgaccggaccggcgccttccccgccgagaacatctccgatctgcacgccgccggactgctgggcctcctggtccccgaggagtacggcggccggggcgccgatctcaccacctgggcgctggtggtcgccgagctcgccgaggcgtgcggttccaccggactcatcttcgcgatgcactccggggccgtacgcctggtggccgccggcgcggccggcagcccgttcgcggagcgcgtgctgcgcgaggtggtgaccgaaggcaagctgctggcctggggattctcggaaccgggcaccggcgcccagctgctcgccccgcagctgacggccttccccgacggagaccagctgcacctcagcggaacgaaggcgttctgcacggccgccggccacgccgactactacctggtcaacgcggacagcggggaacaggacttcctgaccggccagaccatggccctcgtgccggcggacaccgtcgggctctccgtcaaggaggtctgggacgcactgggcatgcgcgccaactgcgccaacaccctgctgctggactgccggatccccgtcgggaacgccatcggcgggcccggcggcggcctcctgctgctctcgcaggcgctccccgcgctcttcctcggtctgagcgcggcgtcgctgggcgtcgcccgcgcggcgcgggccttcgccgacgcccatgtgctgcggcggaccctggccaacacgggacagcccctcgccgccttccagggcgtgcggctgcacaccgcggacatggccgtctccgtgaaggtcgcccacctcatgctgctgcacgcggcctgggtcgtggacaccgacccggcgcaggccatccccgcgctcaacatggccaagtacgtggccaaccgggccgccctcgacgtcgcggacaccgcgatgctggtcaccggaggccgcggctacctgcgctccaacccgctggagcgccactaccgcgacgcccgcgccggcgcggtcatgggatcgaacctcgatgttctcagggacctgatcggcaagaccgcgctcggcctcgatcccttcagcgacaccgtccccgagcgagacccggcacaggagccagcatcgtgaccagccccacccccacgtccatccccatctccacctccacctcctccgagctgtccgacgaggccgtgctcgccgccctccgcgagacgctggcggacgtcctggaggacgacctgctggagcacgtcgacctggactcgctcggacgcggcacgcacctgctcagcctgccgctcgactcgatcaccctggtcgacctgatgacccggctggaggaccggtacgcggccgccatctccgaggagcaggcgttcgccttccaggtcgtcggcgatctcatggaccacatcgcggcccactccacggccgcccggagcggccgatgagcacggtggcctaccgggacctcggccgccacggacacggagtcaccttcctcgactcccgcggcgtgaccgcggagctcgactacgccgacctggagcggcaggccaggtccgtcgccgccggcctcggcgagcgcggtctgcggcgcggcgaacgggtgctgctgccgctgccgacgggtcccgactacctggtcgcgctgctcgcctgcctgctggcgggcgtggtgccgtgcaccgtcgccccgccgccgaacaccggcgcggagtccgtcggagtacggcgcttccacgccgcccgcgccgccgcccggcccgcggcggtgatcatgcccgacaccgccacggcactcgccctggcggaggagggcgcggccgtccacctgaccctggacgaactgcggtaccacgagccgctgaccgacgaccggctgccggagccccgcccggacgacatccaccacatccagctgacctcggggtccaccagcacccccaaggccgccgcgctcacccacgccaacaccgccgccaacctgcgggccctggtggaggccaccgggctgcgggccgaccgggaccggctcagcgaatggctgccgctccaccacgacatgggcttcgtgatggtcctgctcgccctctccaccggcgcgccgctcgacctcatgccgtccatcggcttcctgcgcgacccggtctcgtggctgcgccatctggcggtccggggcggcaccatcaccgccgcacccccgttcggctaccggaccgcgctggagcgctaccggcgcaagccggagccggggctcgacctgtcccggctgcgccgggcgtacgtcggggccgaacccatcccggtggacgtgctgtcggacttccaggacgagttcgggcggcacgggctggcggaggacgtgctcatcccctgctacgggatggccgagacggtgctggcgtccacgatgccggccgctccctaccccggcggccccctgacccgaggccacgtgcgggcgctgcgggtggaccgcgcggatctccaggactccggccgggtcactcccgcccgtgccgggcggaccacgctcacgaccgtctcctgcggccgtccgatcgggggcctcgacctggaggtcaggacggggaccggcgggccctgcggggagggcgaggtgggggagatccacctcggcggcgcctccgtgatggccggctacctggggccggacgggcttcccgtaccgccgcccggagggaagcacgccaccggcgacctcggcttcgtcatggacggcgagctgtacgtcgtcggacgggtcaaggagatgctggtggtccgcggccggaacattccgccgtacgacgtcgaggaggccatcgaggcccaccgggccgtcatgcggggcaacagcgcggtcttctcgtacaccgacgacgcgggcggcgagcacgtcgtcgcggtcgtcgaggtcgcgcccgcggacacggccgacggccggctgcggctggagatcgacaacctcgtgcgccagggcttcggattcgggctgcgcgacaccgtactggtgaagcgcggtggtatcgcccggaccaccagcggcaagcggcagcgcgaccggatgcgccggctgtacctcgccggggagctggcgtagatgggcggagtgctgaccggcaccgggcagaccgggcacgcccgggacctgcgggaggtcctggccgaactcccgaccggggtcacggtcctcagcgccatgaccccggacgggccggtggggatgaccagcagcgcggtgacctcgctgtcgctcgacccgatgctcatgctggcctgtgtccaccggagttcgagcaccctggccctgatcctggaggccgggcggttcggcatcagcgtgctggggagcgatgcggcggcggtctccgaggccttcgcccaagggccgccgctggaccggttccggcgggtgccgtaccgcacggagcggggcgtgccgctcctgcgggacgccctggccggcctcacctgcgaggtgttcgacacccaccccggtggggaccacaccattctggtgggccgggtgaccggggccgcccgtgccgacggcgcggccggcacgcctctggtccggcaccggggaagctaccggggcctcggatgaccccgccgcccggcacggtcgacctgtggtcgctgcgcgccggacccggcaatgtcgccgccgcccggcgcgcggagtccgtactggacgcgtcggaggcacggcgggcggagtcactggctccgcccgccgcgcgggacacctacctggtcgcccatgtgcggctgcggcagatcctcgggcgccggctcggactggctccggccgaggtcgggttcacccgcgaggaatgtccccgctgcggtggccggcacggccggccggccctcgccaccggcaccgggttgcacttctcgctgtcccacaccggtgaccgcgtcctcatcgccgtggccggcgcacccgtcggcgtcgacgtcgaagccgtcggccgcaagccgcgacccggcctgctccgccggctccaccccgaggaacgcgcggccgtctccgcgctgcccccgggacggcgcgacgaggcggtgctgacctgctgggtccgcaaggaggcctacctcaaggggaccggggcgggtctggccgacgggctggagcgcacctacgtcggcacgggccccggcttcggccggcccgagccgcggcccgcggcactcggcgactggtggctcacggcggttccggtgccgccgggccatgtcggcgccctcgccctgcgcctgccggcgggcctctctcccctcccgatccggatccgcctccgaccgtgagccgcggactccccttcccacaccacgaagaagcaggacgcacacagatgacagagcagaacacggctccggccgtcgatccgagcacatgcggcgcggcatccgccgcaccccgtatccggaccgaggggaactgatgccgcagcctgtggtcctgtccggcctgtcgggctggctgccctcccgtacggtggacaacacggacgtgctggcccgtcttcccgagggcctgaccgaggagtggatcgtccagcgcaccggaatccgggagcgccggcgcgtggaaccgggtatgtccacctccgacatggcggtgcgggcggccgcgccgctggtcgcctccaccaccggtcgcatcgacgccgtcgtcgtggcgaccaccaccccggacttccccattccggcaaccgcgcccatcgtcgccgcggaactgggactggtcgacacggcggcctgggacgtgaacgcggcatgctccggcttcgtcaccggtctggccgcggtgacctccatgatctccgccggagtgttcggccgggccctgctgatcggggccgacgcgatgtcgaccgtggtggatcccggtgaccgcaacacggcgatcctcttcggcgacggggccggagccgtgctgctggaggccgactccggcgccgagaccggctccttcggtcccttcgacctgggcagcgacggcggcagcacacggctggtcggcatcgacgccggtggctcacgccagcgctcacggaccggcccgtccgtcgtggccgaccgcgaccactacctgcgcatggccggaccggagctgttcacccacgccgtccggcggatgaccgcttccggcgcgacggcggtcaaggacgcgggctggcagccctcggacgtcgactggctcgtggcccaccaggccaacgtccggatcctgaccgccgtcgcggaccgcctggacatccccgaggaacgctgcgtcgtcaacctggacctcgtcggcaacaccagcgccgcgtcgatcccgctggcgatggcccatctgcaccgctcgggccgcgcacgcgcgggggaccgggtcctgctcaccgccttcggggccggcctcgcctggggatcgaccaccctgacctggcccgacctgccccactgactccccgccccgaactcccctcggctcgatccacgagggaaccgaactaccacgtaaggccgatccatgtctgacacacagcaactagccgactccgtacgccgcctgctcgcgacgacgctgcgggtcgaacccggtgacctgaccccggacacctcgctcggcgatctcgggatggactcgctggcggaggtcgagatctccatggccctgcaggacgagttccgctccgatgtcgagcccgccgacttccgggacgagaccgtcggcggcctcgtacagctcgtgatacagggacggagcggccgatgacggcggtgaacgcccccgagtacagccgcttcgaggccttcggccggtgcctgccgtccctggagcggacgaccgaggaggtcgtgtccggcaccccggtctcggcccgcgccctcctcatgctgacggggatccggcggcggctcgcctgcgatgtcgacgccggcgagtgcgcggagcagctggcgctgtccgcggcccgggactgcctgtccaagtcccgctacgacgcggcggacctggacgtggtgatctcctcggcgatcttccgttcggacgagcgccggcgtctgtccttcgaaccgtcggtcgcctcggtcatcgcccgggagatcggttcgacggccgccacctgcttcgacgtgagcaacgcctgcgccggcatgttcaccgggatcctgctcctcgaccgcatgatcaaggccgggacgatccgccggggcatggtcgtgagcggggagcacgcctccctgatcaccggcagcgcccggcaggagatcgccggcctgcgggacctgcaactggcctcgctcaccgtcggcgacgccggaatggcggtcatcgtggacggctcgacggacgcggccgaccgcatccacgccttcgagatgaccacctccgcggcgtacgcgtccttgtgcaaggcgatgcccagcgacgagacggcaggtctggtcatgcacaccgacagcgcccgccagcaggcctcggagcgtatgcagatcggtgtcagcctcacggaggacgtccacgcgcgtgcgggccggacccccgccgacccgggcttcgcccattccatctaccaccagaactccgtgcagttcgtcgaacgggtccacgccatggccgaggggatcttccacccgacgtcgcccgaggcgccagccatcgtgcaggacttcgggaacaccggctcgacttcccaactgctcacgttctacgagcacttccggcgggggacgatctcgccgggcgacacgatcgccttcgcgcccagcgggtccggcatcgtgatcgggcacctgtccaccacgatcacccacacgaaggtctgacatgtccgtcaccatcaccgcgaccgccgcctccgcggccaccggggcgttcacgcgcgcggtcgacgccgcccggcagtgcctggcggcggccgagctcgaaccgtcggacctgcacatgctcgtccatgtcggcctctaccgggaggacaacgtcgtcgaaccggccctggccgccctggtccaggaggcgatcggcatgcgcccggactacctgctgacccgcgaccccttcaccggtttctccttcgacctgatgaacggtgactgcgggttcctgaccgcggttcagctcgcccaggcgttcctcgtgcccggtggtccgcggaacatgctcgtcgtggccgcggacggccatcccggcggccggccccaccccgcgttcccgtacgccgaggcgggcggcgccgcactgctcaccctgagcgacagcggccggggattcggccgggtgaccctcgactccgaccgcgcgcaccccgtccagcggcgggggtacctggatctggacaccatggggacggaggggcgccgcacggtgaccatcgagcaggacctcgacgtgcccgccctcaccacccgggcggtcgacgcggccgccgcacgactgcgcgaggacggcgccgatcccgaacggacgctgctcgtcacctcgctgcccacaccgggcttcggtatcggcatcgccgaagggctcgggcttcccgcgaccgccgccgtcaccctcgacggagtcgacgccgaccccagaacctccgccctcaccctcgcctaccaccacgccgccggaacggggcgactcggtgcgtacgacaccgtcctgttcgtcgcagccgacgcgggatccaccatcgccaccgctctctacaccctctaggcaggcaaccgatgccccgcatccgctaccccgatccctcccgcctgcccgacgacgtcatcgccgccatcgacggccggccgctgccgaacgtgacccgcgccatgctcaactcgccccacctggccctggccgtcgcccagcagggcatcactcagttcaccgccctggcccttcccgcggacctgcgtgaactggtgatcctcgccgtcgggcaccgcaacgcctgcgcgtacgtgatcgcgcaccacgaaccgctcgcgcgagcagcgggctgcaccgacctccaactggaaatcctgcgcagcggcgaggcgctcggcgaggccttcggcgacagccggcggcaggccgtcgaactggcccggagggtggtcgaccgcgagaccgtccgcacgggcggcccggccgatcccgccgccggattcgacgaccgcgaactcgtcgagatcgtgatcacggccggctactaccagatgatctgcggcttctgcgccgtcgccgaggtggatctcgaaccggccgccgacagcggcgccctcgccgagtcggccggtgcgagcgcgccacgcacccgggcagcgcgagcacagccatcgaagtagacgtgacgaagtcgaaaggcgcccgtatgaccggacacgagacggacgaagcagcagaggaagcagcagaggaagccgcgcaccgggagttcctgcgccttctcggcgggctgcggatctggaaccatccactccccgggttcgaccccgtcggtctgcccgccgaaccggtgtcgctgttccgtacgtggctcacggaagccgcggcggccggctgtccggagccgcactgcctggcgctgaccaccgcggacacggaaggccgcccctccgcgcggatgatgacgctcgcggacgccgacgcccggggctggcacttcgcatccctggagaccagccggaaggggcaggagctcgacgggcgccggcacgccgcgctgctcgcctactggccggtccacgggcgccaggtgcgcatccgcgggccggtcaccctggcggacgcggccgccggggccgcggatctggccggccgctcgccgggcgcccgggccgccgccctggccgggcggcagagtgaggtcctcgcccgccgcgaggacctggccgcggcctacgggacggcgcgcggcgcactggcggacgacccccggacgccggtgcccgcatggcggcggtacctgctggagcccgacgaggtcgagttcttccagggagccgccgaccgccgccacatcagagtgcgttaccgccgcaccggcggtgcccgaccccagtggacccaggagctgctatggccatgaccccccgggacacggagccgaggaccggccctccgacggtgcccgcgtccgcaccggccggacacccgcgccgttggctgatcctcctcgtgatgtccctgtgcatgttcgtcgccaccttggacaacacgatcctcacggtggcgctcgccccgatccagcaggcactggaggccaccaacggtgagctgcagtgggtcatggacgcgtacgccctcaccttcgccgccctgctgttcaccgccgggctgctcggcgaccggttcgggcggcggtgggtgctcgccgccggcctgctggtcttcctgatcgcctccgcgttcgcctcctggtccgcggatcccgcccaactcatcatgtggcgcgccctgatgggactcggcgccgccgtcgttcccggttgcagcatggctgtgatcatcgacgcgttcgtaccggaggaacgcccgaaggccatcgcgctctggtcggtggccaccggtgtcggtatcgccgccggcccggtggtgggcggtgcgctgctcgcctccttctggtgggggtcggcactgttggtcaatgtgcccctggccctcgtggcgatcgttctgatcgtctggctcgtaccgcagcgccgggcggagcacccggtgccgctcgacctcccggggatgctgctgtccattctcgccgtggggtccctggtgtacgggatcatcgccgggggcgagggcggaagctggatcgcccccggggtggccggaccgatcgccgcagggctggtgctcctggtcgtcctgatcctggtggaacgccgcagcgacaacccgtccatcgatcccgaactcttccgcagcgcacgcttcacggccggctccggcgtactggcctgctcgttcttcgtggccatgggcgtcggcttcatcctcaccttctacctgcagcaggtgcgcggaaattccccggtcgaggccggactgctgaccctggcctacgcggtcgggacgacggtcgccggcgcgaagagctcccggctggccgaccggatggggccgtcggcgaccgtcgccgtggggatggcggcgatgggagccgggtgcctcgcggtctccgggctgggcgaacacacccccgtgtggatcgtcgagctcacccaggtcgtcttcggcgcgggcttcggactgacgctctccccggcgatggcggtcgccctggccgtggtgcccgacgccaaggccggcgcggggtcggccgtggtcaacaccgtgcgccatctgggctcggcactgggcgtcgccgtactgggtgccgttctcggtgtcgtgtaccgcgaccggttcggggacggcggcggcctcttctcccacacgcagcaggccgccgagacgaactcgctgggcagcacactgctgcggctggcccacctggggtccaccggccacgacccccaggcgctcgccgcggcggcggctcacgcgaaggactccttcctggccgcgatgcagaccgccacctggatcggcgcgggattctgcctgatggcagcgctgatcgcgctccgctggctgcccggacgcccgtcccgctccgccggctcgcacggccgccgatagtgtctctgaccggacacacgggcggagaagtacgaggtgggtatggagacgcatcgtccggggcggccggaggaccttcccgacgcgggcgtgctgtgggcgcgctgggccgcgttcgccgtggcgacctggaacgccgaggaggagaacgaacgcttccggtacgggtactggctcggggacggcgaccacgatctgcgctacgacgacggtgcgtgcagccggtgggcactgctccggggcgacgggggccgcgctgtcctcttcgggcaggacgactccagcacggtcgcgcggtacgagcccccgatcgatctcctcgccggggcgcccggctgggtgcgccatgcgcgcctggacgagctcctggaccagggaagggtcgagtgcgtctactggttcgagggcggttcctggcaccgtgccccgtaccccggcgaccttcacgacgacgggctcgactgcgggatcggccatctgacctcgcgtgaacgcgccgtcggcgcgatctgcgcgctgttcgagttggacgacgactgcgagggcgccgtggaggcctgcgggcggttcatcgagcacgcggagcggggcacggtcaccgaggaggccgtgcgttccttcgccgatgaggtcttccggatccagaccgcgtacgaactcctctggccccgggtaccggtcgcccggtccgagacggacctggtggggatgaccgcgctcgtgcgctggagctgaccccgcggagggcgaacagcacgacaccccggccagcgggcccgcccagtgggcgggagcgctgccggggtgtcggcttcggccgggaggacgtctcaggccgtggcgggcgcgggggcctcgggggacttcgggggctccggggtcccggcggggtcctcggcgccggattcggcatcggggtgggggatgcggtgcagccccctgcggtcgtagacgcgggtgacgacgaagccgaagaccagtgcggcgacgagggcgacacccatcgaggtccaggcccgggtcaggcccgcgtcggcctgggctccgtagtagaggagggagcgcaggccctcggtgatctggcgcagcggctcgaactcggacagggcgcggaagaatccggggagcgcctggacgggcacggtggcgccggaggagggtacggccatcgcgacgaagacgatggtggccagcagcatgccgggggtgccgaaggcggcgaacagggccaggctcccgatgccgaccaccgcgatggtggcgaccgagtacagccacagcaggccgaggtgggaggcgtccatgtcgaggatggcgacggtggcgacctcgaccagggtgcccatcacgagcgacatgccgagcatgagcaccatgccgacggccagcgtgcggacgcggctggtgtgctggacgggctcgcgcttgcggaccgggccgtagtcggtgtgcaggtagccgagggccgtgtcgacctgggagttgacgaggttggcgccgagcatgccgcagacgacgaggaccagggcgtagtagaaggcgctcaggcccatggcgctgcgcgggccgacggggtggccgtcggcgaccgtcacggtcacggggtcggccagcttgagctgggccgccgtcgggaggggggtcttctgggcgccggcctgcttgaggagttcctggccgagctgggcggaggcggcgtgggccgccttctgggcggcctgggaggacatggaggagccgatgctgcccgccgcctggttggtcagcacggtcagggtcggcggggccgccttgcccgcgggcgcgggctgcggcgcgctgagcgcggccaccgtggcggagtagtcggcgggtatgacgagggcgccgaagaccttgccccggcccagccgcttgtcggcctccgcgcgggtgacgacctgccagtcgatgctcttgtccccctcggcggccttctggatgccggagaccatctgctcgcccaggttgatgtggccgccgttgacgtccgctccgctgtcggagttgaccagggccacgggcaggtcgcgcaggttgcccttggggttgacgtttccaccgacgtagagcagggcgaacaccatcgagaccactgcggcgatgaggcccgtcccgatccacagcttgggtcggcggagcacggagggtggcgtggggtgaggcatcgattctccggtgcggctgcgttcctaggttggatacttatggtatccagttactggatagtggcagtatcttgctgtggtgtccaatcgccgacgacgcgacggacaccggaccgaccgcgtgaccagcagggaagccgtatgaagatctcggagctcagccggcggaccggcgtgccggtcgccagcatcaagtacttcctgaggcaggggctgctgcccgccgggcgggcgacagccgcgaccctggccgagtacggggacgagcacgcgcagcggttgcggctgatcaaggccctgaccacgctcggcggcctctccatcgccgccacccgcgaggtgctcggggccgtcgaccaggcccacagctccgagagcgccctcggggcggtcagctacgcgcttcccgtgccggtggcggcccagggcgccgcggtccacggggcggaggccggtgccgaggccgaggccgaggccgacgggaccgccgccgccgaggtggcggagctcctcgcggccctggactggcaggcacccggcacctcgccgcacgtgcaggggctgacggtggcgctggaggagctgcgccggctggacgcccagtacgccccgggcgagctcgccgcctacgcgaggctggcggagtccgtggcccggctggacctggagcgcgcggcgggcctggacgacccggtggcgctggccgaacgggccgtcatcgtcttcgcgatctgcgccccggtgttcgagctgctgcgccggctcgcgcaggaggaccaggtccggcgccgggtcgcgggcggtggcggtatcagcaccggtggcgacgtggcaccgcggtagcgcccgtggacggccgggccgggagcggggtcagggcggcgtactccaggggtgcggacgggtcgacggacacgttcagcggcgccggctccgcccccgagcggaccaggaggtcgccgacggccgcgatcatggcgccgttgtccgtgcacagcgtcatgggcggaacgcgcagttcgatgccggaggaggcgcatcgccgttccgccagggccctgacccgcgagttcgcggccacgccgccgaccacgatcagcgtcttcacgtcgtaggcgcggcaggccgcgagggccttgcgggtcagcacgtccgcgaccgcctcctgcagcgcggcggccccgtcggccaccggcggttcggtaccgcgctggcggtgcttctcggcccaccgcgcggccgccgtcttcaggccggagaaggagaaggcgtacgggtcgtcaccgggccgggtcagcgggcgcgggaaggccaccgccttcgggtcgccgtcgcgggcggcccggtcgatggcgggaccgcccggatacggcaggcccaggatccgggcgaccttgtcgaagcactcgcccgccgcgtcgtccagggtgtcccccagatggaggatcggctcgcggaccagatcccggaccaggaggagcgaggtgtggccgccggagacgatcagcaccacgcaggggtcgggcagcggaccgtgctccagggtgtcggcggcgacgtgtccggccaggtgatggacgccgtacagcggcacgccggccgcgtacgccagggtcttcgccccggccaagcccacctgcagcgcgcccgacagtccgggtccggtggtgacggcgaccgcgtcgatccggctcaggggcaggccggcctggtcgagggcctgccggacgaccgggttgaaggcgtgcagatgcgcgcgggcggcgatctcgggcacgacgccgccgaaacgggcgtgctcgtccatgctcgacgccaccacgtgcgcgagcagtctgccgtcctgcacgattcccgcgccggtctcgtcgcacgacgactcgatcccgagcaccactggtccgctcactgctctccgccttcttgtgcacctctgctgcaactgcaacctatatgcaataggaggccgtcgggttgaccgggtgcgggtaccgggacgccgccggacgcccgcgtccggcgcggggccgtacgcgggcgcggaggcggacgtcgggtcagggtcaggcgtcgcggcgccaggggatctcggcccacacctgcttgccgccgctgagcggcaccgagccccaggccgtcgtcaccgcgtcgacgatgagcagcccgcggccgccggtcgactcccagctcacccagaccggtttgacggggctgcgaggcgacgcgtcgttcacggcgatccgcagccggtccgcggacagggtcagatccatccccacctcgccctgcgtgtgcgcgatcgcgttggtgaccagctcggacacgaccagcagggcctcgtcgacctcctccgtcatgccccaggaccgcagggtgcgcgccgtgaagcggcgtgcgtgcaggaccgcgttgggcagtcgccacaccgtccagtgactgcgcctgggccggtctccctggccgtcgtagcgcagcagcagcaacgccacgtcgtcgtcgcggcggcccacaccgacgaccaactcgtcggcgacccctccgacgtcgaccgggtcggccgcggcgagcacgtcgcacacccgccgcatgccctcgtccagggggagcctggcggactcgaccaggccgtccgtcagcaggaccagcagggtgccggggaccagccccacctccgtcatggggaattccgcttccgcgagcacacccaggggagggccgccctcgaccgccatctcctcggcgaccccgtcgggatgacgcaggaccggcggcagatggccggcccgtacgacccgggcgatgccttcctccatgtccaggtccacgtacccgcaggtggcgaacaggtccgtctccatgccgtcgagcagacggttggcccgcgcgaccaccacgtcgggcgggtggccctccaccgcgtaggccctgaccgccgtacgcatctggcccatgatggtggccgctcccgcgctgtgcccctgtacgtccccgatgacgaacgcgacatgcccgtcgcggagcggaatgacgtcgtaccagtcgccgccgacctccagcccggccgtcgcgggcagatagcgggccacggccaccccgcccggcagctccgggagcttccggggcagcaggctgcgctggagcatggtggcgagctcgtggcccgcgtccagcgcgtgggcgcgtaccagcgcctgccccaccagcccggcggccgcggtcagcagcgaccgttcctccggcccgaaccggtgctccgtgtcccaccccaccagacacaccccgaccatccggccgtcggcgggcagcggcagcacggccagaccacccggcccgacgcccagcagcccgggttcgagatcggcgcccggcggccacaggctcaggtgcccgccgcgcagcgcgctctgcagggtgggcaggtcgctgagcgccacgtcgggccaatcggaccgccactcggaacgccacacctcgggccaggcatcgggctccggcgggtcgagggcggtgacgatgagccgttcgggctccagttcgccgaccgcgacccgggaggcgccgagcggctcgcgcagggcggcgaccaccagccggctgacctcccggatggtcgccgcccccgccagggtggccgaaagccgctggacgagggagacctcgtcggcgctgggccgcagataggtggcatcggccaccacacccaggacgcgctgcggggtgccgtcggggcccacctccacgcggcaccgcagccccagccagcgcagctcgccattgggccggcggatgcggaacgccagctgctgtccggcagcggccagccggttcggctccacgatcgccatcagcgcgggcatgtcgtcggggacggcgcaggcgagcacggtctccacctgcccgtcgaactcctcgggaggcagtccgagcagttccagcacgtgggcgtgggcctccatccggccggtgctcagttccaggatgaacgcgccgccctggtcggggacgagcgactgccccagatgagcctgcggggccttgcgtccggcgaagcgcgcggcgaccgattcgagtcccgtggccacctggtcggcgtagagctccagcaggctgcggtcgtcggcgctgaagccgtccccggcctgcccggcgacgatcaggcacccgagctcctggtcgtcgtaccccagcggcagcgcgcccagcgagatcctggccggtgagttggggtcaccgtcccgcacgcgggtggggaagtggtgggggtcctcctcgatgaacgtggcgagttccttgggggccagccacagcgggcggccggagcggaaggcattggcggcgggggagtggccggccacggcgaggatcgccggcagtccgtacaggacgccgcggtttccggtcagctcggcgagatggagctccctgccctggtcggcgaccacgtagacagcggcgagctcggccccgcagaacgagaagcgatgactggtcactgtccgtagcacctcctcccgagggcatctcgccgaccgctctctccatgctgtcgcgtcccggaccgtccgggcgagtccacgggcactacgtcggacctccggccgagcggttcccctcgtcctcgcaccggtcgacgacgacgaccgccacgtcgtccgccaggcggttgcgggtgtggtggatcagggcctggtgcaggcccgtgaggaacgcctccctggtgaggtcgcacatgctcaccatggccccggccaggtcgaagaagatcttttcctggtcgcgggcctcgatgacaccgtcgctatacagcagcagccggtcccccggcacgaacggatagcgctccgcccgcacgggaggaccggcgaggaattcctccagaccgaggggcggcaggggaacggtgggcatgaggggccgcaccgagccgccggacagcagcagcggtggcggatggccgcggttgatcacctcgatgtgcgggccgtccgggacctgcgccaccagggcggtgacgaatccctccaggagggcgtccgcaccgccggcgcccgagacggcggcgtcccgccgcagggccgctccgcagcggttgacgacctcgaccaggtcgtcctcgtagtgcacggcctcccggaacgcgcccagcacgatcgcggcggcccggacggcgggcagtcccttgccccggacgtccccgacgatcatccggaccccgtaccgggtctggaccacgtcgtacagatcgccgccgatctgcgcgccggtctcggccgccaggtacatgctggccgcccgtaccgagcccagccggtccggcaccggccgcaggacgacctcctgggcggccgtggcgatccggcggacctggttgagctcgttctccgtacgcgtgcgcgcggagcggctcgtcaggaaactcgccacggacaccaggaacagggcgaggaagttcgtgtagacctgctggctgccccaggccccgttgtagctggcggtggtcacgctgacaccgacggccacccccgccgccgcgagcgtgccccgggggcccatcgtcacggctgccagagcgggggtcgcgaccagcagggggcccgtgtagaggacgtgcaggggtgtgaactcgacgaggagcaccagcagggcgatcgcgaagggcacgcactccgccaagaggaaaaggacctggtggtggccatcggctcgcggtccaggaggcgagcgcaagggcgctctcatgagtacagactgcctcgcccggaccgggggccgccactccggcggaccgcccccgaggacctgcggccacggccgccgccggcgctcgcggagtgctgccgggccgcccggcctcagccgcggaccggtgtgaggaccacgaagtcggcgttcgcgggggcgaggcagacggcgagacggcccaccccctccgcgtcctgcggccccatctgcacacggccgccgttcccggtcaccgcggcgaccgctgcgtcgcagtcggcgacggcgaagacggggtgccagtacggcctcccctgagcgagggtgaggtgctccgccgggagctccatgaggccgccgtgcatccgctcctccggaagtccggcgggggtgatgagggcgtaggcgcccccgccgccgggcagcgccatgtcgccgaaccgccagccgaagaggccgccgtagaactccttcgcggccgcggcgtccgtcgtgtacagctcggtccagcacagcgagcccggtgcgtccaccagctcgacaccctggtccctccccggctgccagacggcgaactgtcccccagggggtcgctagaaggcggcggccgcgcggacgtcgggtgccccgagattgagccggccgggcggctcacggcaggcttcggcggcgacgcaggacggccgcgccgaccagggccgccaccgcggcgaggagcgcggccgccatgccgtagaccatcggggtaccgacccggaccgggtgcgccgtggcggcgcgggcggcgggggacggcgccgggggcggagcctcgggcagcgccgggggagccagtgatccgaccgggtccacatggcccgccgcggcgaatccccagtccagcagcgaccgcgcctcctcgtacacggcgttcgcgccgccccactgagggttcatcaccgtcgccaccagagtgcggccgtcccggcgcgcggccgcgatcagggtgaaacccgcctgggaggtgtagccgttcttgaccccgatgatccccgggtaccggcccagcccgtcctggccggtcacgagccggttggtgttctcgatcccgtacgtccaggtgggactgccgtcggtgtgggtaccgccggggaagcgggcgtcggcggtcgccgcgtactcggcgaaggccggatcggcgagacccgtacggccgaagacggcgaggtcgaaggcagaggaggcctggccgtccgcgtcgaagccgtccggggagaccacggtcgtgtcccgtgcgcccagggcgcgcgccttggcctgcatctgcgccgacgtgacgtcccagccgccgttcatcgcggccagcacgtgcacggcgtcgttgcccgagctgaggaagacaccccgccacaggtcggccacccggtaggtgtggtccgcggaaagccccaccgtgctgcttccctccggcacctcgtccagctcggcgtcggtgaccgtgtgccggctcgatccgggcaggtggggcagtgcggtgagggcgaagagggtcttgagggtgctcgccggcggcagccggcggtgcgcgtcgtgcgccgcgagcacggcgccgctaccggcgtccgccaccagccacgacagggcggacacatcgtccggcagcgcgggcgccccctgccgtgcccgtacgtgggtcccggagcggtgcaacagcgatgcgtctacggacgaggccggtcggggcggcagcggctcggccggggtggcgcccgaggccgtcggcacgaggagaaccgatgcgccgacggcgagagccgccgcgcccgtgccggtcctgcgcccggaggatctgatgctcattcatccagcgtagaaatgcatcgggccgcgcgcagcgacacttacgccgaccggaggaaggccttccggacggcctcgccgaagccggcggggtgcgtcgtcaggccgatgtgtccgccggggaagtgcaggagctccgtgccgaggcgctcggccagaaatgcggccgggcggtacgggagttcgccgcgggagtcctggccgcaggcgagcacgagccggtccgacagggtctccagccgctcaacgtcggggacgtaggacatgaaggcggggacgatgcggccgaggaagtacggcaggccggccatcgtccgcccggcccgtgccgccgcctgcggcggaagcccggcctcggccgcccgcggccccgcggggccgccttccttcctcagcccggcggcgaactcggccatcgccggcatgagcccccgggcatcgagggtctcctgcacgcgtgcgaggaacacccggtgcgcgggggcgtccggcagtacctccacgaccgggggctcgtgcgccacgacgcgcgcgaggcggtcgggacgggcggtgagcaggtgcagggcggcgatcgcgccggagctggtgccgaacacccgggcgggctcaccgggcgacagcaggtccacgagccgcaaggcgtcgtcggcgtgctgggccacgtgctgcccggcctcgggatcgtccagcgggctccgggacataccgcgcgggtcgtaggtcgcgacggtgtactcggcggccaggccgtcggcgatgccgtcgaaggcggcggcgccgcccgtcccgccggggaccagcagcaggagcgggccctggccgcgcacttcgtagtgcagggtcgcgccgtccacgcgcaggctgccgaggtccgggtgggtcacgaggggtctccttctcggggtgcgggccagtgctccaggagggtgtggagggcgtcgagggcgcggatccacgagcgctgcggtgagcgttcgtgcgcgaacccgcccgcggcctccagggcgacgaacccgtggaacgtgctgcgcagcaaccggaccgcgtcggtcaggtcgggctccgccagaccgtagccgtgcagcatgccgtaggtcagctcgacggcacggcgcggtccgggcgcccgcgcggccagctcggggtcgatccggatcggggtctgggtcgccgtgtagcggcccggatgcgcgtgcgcgtaggcacgccaggcgtcggcgaacgcgaccagcgcgtccttgcccgaccgcccggccgtcgcctccgcgatccggagggtcttctcgtccgccgccagcagcgcgatccgtccgcgcaggtcttccaggccgcgcacgtgcgcgtagaggctcgcatccttcacgccgagccgccgggccacctgcgacatcgtcacccggtcgagtccgacctcgtcggccaactcggcgcccgcgaccgtcacccgctccgccgtcagccctgcccgtgccatgaaccctccgttcctaggggtcctagttttaacctaggacccctaggaacgcaaaggggaaacgcgctcaggagacgagggtctgctcctccagctcggccagccgcaccgtgcacaggccgccgcgctcgctcttcacgtccgtcaccttgagctgcgtacccggggcgaggatgaattcctcctcacccgtgaacgccgagaacctgcggatgccgaccgcccggaccggggtcacctcgaacagcgtccgcctgccccgcccaccgaggaacgcccgggccacgccgacctcggacgtgcacgaggacacaccccaccaggtcaccgtccggccgagcggatactgggcccgcaggtccagcgcgaccccgcgccacagcggctccgtacggaccggcagctccgccactgccgagaacagcagccgcaggtacgggaggtacggaacgagccgggcacggtccggggagcgcaggacggcgttgatctcccggtagaacgcggactcgcaggtgtagaggtggagcgcggcgatcgcgtcggcggagagcccgtccgccgacccgtccgcccgccccaggccgaactcgtgggacagcttgacgtgccggtccaggctggacagcacctcgacgaccggggtgacggcgtcctggaagcccatcagcggggtgtcgaacacgccgctgatcgcggggaggacgagcccttcgtccttgacgctcgcgagccggtccaggtacagctggtgcagttccatggtggacgagatgaacgcgcccatgcgctcggcgacatcgccgtccgctccgccggccgccggcagcgccgcgttccaccccttgctcggcagccagtcgatcgcgtcggcgcccagcgacgcgagggcgtcgttcaccatgccgaagtggtcgccgtcgcagaagacgtcgccctgcgcggcggggttggggtggtcgatgtggcgtacctcaacctcggggtacttctcctggagccgcaggacgaccttcttcagggagcgggcgtgcgccccccaccaggcgaagacgacaccgcggtcctcctcggcggcgttctgcttggccttgaggatctcctccgcgatccgctcggccaccggacgccagaaggcggtgtgccggtcgacgcccgccgccccgtcgctgcccgcggtgagcgccgcgttcagcagcagcacgccctgcgtgagcatcgcctggaaccactccggcggctggaccgtgtcccgttccttcagcagggaccgcacgtcggcgatgggggtcttcttcacgatcccgtacttccacatcgccgccgccttgatgatgcagcggatgctgacgaccctcccgaactggctgtccgtccagtcgtggaaggtgttgtcgaacatggctatgccggtggcgctctcgggccgcgggtacgggttctgaccgaagacgaccaccttccacttgtgcggcgggttgggcttgagcgcctggaaggtcagttcgcgcacggggacggtctcgggaccgcggccggggccgatgaacgccgcggcgtccggctgcgcttcgatgacgggcttcagcagcggaagccacggctcaccaccgcccttgaacagttcggcgaggcccagcgggtcgtcggcgtcgggctgggcaggggagggtgcggcgtcgctcatggaagtgctccgagtggtcggaccgtgccggcgggcacgatgaggacacgggcgagccgcccgtgcgggtctcagatctcaggtgtcaggtgtcgggtcctcaaaccggcgcgagcggccgcaacggcccgtacgcgtagcaggaatacgcgtgggcaggcggtcggcgctcgtccgcggcctcgggcgtcgaggcgtggccgacgggaatctggcggcaggctaacaccgggccgggaggcgcgcaatcgtgacgggacgtcatcgtccgtcgccttcgggggcgttgtcagtggctcgcggtagcgtccttgagcagggcaggaaccccttcgacccttttccgatcggagcagaacatgagtgtggaccgtgtgccgtcgccgctgcgagtggtgctgaccgacgtcaacgcggaggtggtccaggcgtggcgggcggcgttcgccgacactcccggcatcgagatccgccagggctcgatcctcgacgaggcggtcgacgcctgggtcagcccgaccaactcccggggccggatggacggcggggtcgacgcggtcatcaagcggcatctgggagcgggcatccagctgcgtgtgcagcgtgcgatccgcgcccggttcgcgggaagcctccccgtgggaagcgcggtgtgcgtcgcgtcaggggcggtcgagccgaagttcctgatatcgacgccgacgatggagcagtcctcgcagaacgtgcgcgagaccctgaacgtcgcccttgcgtgcgcggccgccttccaggcgatccacctgcagaacgccgaagcgccgggcagcatccggtcggtggcgctggtcggcatgggagcccggaccggccgggtgccggcccgggtctgcgccaacctgatgtggaccggctacacgctcttcaacgatttccgcttcgacgactacgacgacctgcgccagacggtcctcgcgcagctcgacgacctcgagagcgggcccgtcgagaagcgggtgcgcatcgcgcccccgcagcggcgcacggccggccgccgctgaccggccggccgcggggcggccgggccggatcagacgatgtcttcggcgatctccgcctgttcgcgggcgttgccgtaggccgccggggtgccgtacgagcggcgtgcgacgtaccaccagacgctggccaggaccaggaccacggccagggcgatcacggcgtagttcatcgagtcgatggtgacgggggacttctgcggcagacagaagaggagggtgacgagcgccacccagacgacggcgatccagccgatcggcttgctccagcggcccaggttccaggggccgggctcgaagcggttgccggcgcgcaggcgcaggtagatcgggatggcgtaggccggagtgatgccgatgacgttgatggccgtcacggccccgtaggcggtggcggagtagagcgaggggagggccagcacgcccgcgacggcgacggcgagccatacggccggcaccggcgtctgggtccggccgctgaccttgcgccacagggcggagccggggagggcgttgtcacggctgaaggcgaagaccatccggctcgcggcggcgacctcggcattgccgcagaagagctgcgcgacgatgacgacgaggagcagcgcggtggcgccgcccgagcccagtgcgtcgatgaagatctgggcgggcgggacgccggtggcgctgtcctggaccgccgcgtagtcctggatggcgaaggtgaggcccgcgagcagggcgaaaccggcgatccaggagacccagatggcccggacgatgcccttggcggcggagacggaggcgttggacgtctcttccgagaggtgcgcggaggcgtcgtagccggagaaggtgtactgggcgagcagcaggccgaccgccgccacgtagaacgggttggcccagccggtgtcgttgacgaactcggtgaagacgaacgaggccgatcggtggttgtccgggacgaaggccagggcgccgacgatcacggcgacaccgcccaggtgccaccagacgctgacggagttgagcacgctgacgaggcggaccccgaagaggttgagcgcggcgtgcagcagcaggatgcacaggaagatcaggaacgtcgatccgggggtgggcacgaacccgaagcggaggttgaggaaggcgccggtgaacagggcggcgccgtagtcgatgccggcgatggcgccgagcaggccgagcaggttcagccagcccgtgtaccagccccagcggcgtccgccgagccggtcggccatgtagtagagcgcgccggaggtggggtaggcgctggtcacctcggccagggcgagacccacgcacaggacgaagaggcctacgccgacccagccccacagcatcacggccgggccgccggagcccatgccgaagccgtacagcgtcatgcagccggagaggacggatatgaccgagaagctgatggcgaagttgccgaatccgcccatccggcgggcgaggacgggctggtagccgagttccctgagccgctgttcctcgtcctgctggggtggggccttgcgatcctggcgggctgcccattcggttctggacacggcggtacctccgggggtctgtggagcacggggacggtggagcacgggggtgcgggtgcggcctgggtggtgcgggtggagcgaggggtctgcgccgtgggggacggcggtgggggtcagttccggccggccaggctgcgggacctggcctgcaggaacacctcctcggccagcgcgcggtcggcggggtcgcgggtccggagggcccacggcagcgtggtccagtacgggccgatcgtgtcgaagacgcgggccgcctcctcgaactggagggctccccacagggcgtgggcgagctggttcagatcgagcggggaggcggtcggcaggtcggcgtgctcgaaccaggtctccagggcgtggagcgcgtcgcggaccgcgtcctcggcgacccagtgcaggtcgagggcccgctcctggccgcgctcgcggcggtagcgctcgacccgtacgtagagcggcagtacgtgcacggcggaacccggcggcgcggaaccggaggcccagtggacgaagttggcggcctcggagagcggtccgggcgtgcccgcgtacacgaactggagcatgcggtggtaggcctcgcgattgtgcgggtcgcgcttgtcggcctctgcgaggatgccccaggggccgggtggcagcatcgggccgggcggcgcgacccggtgctcggccatctggcgctgctcgtcgaggagggcgagggcgaggaggcagacccagggcacggggtcggcggggctgatgcgggcggcctcccggcaggtcgaccaggcctcctgccacagctcgcccgtgcgcgggtgcccggcgcggtgggcgcggacggcgcgttcgacgcagacgcgcgtgtgcatcacgagtgcggcgacgctgtgcggttcctcggcccgccaggcctggaccacgtcggatccggcggacacggcggcgaggacctgggtgcgctgggtccacagcccccagttgtcggtacgttcgagtaagcgcgccatcgccacccaacggccggtgcgcaggtcctgggcggccgaacgcagctccttgtcgtggccggccgggtggtagacgggccggaaatcgccgcctgccatcacctcgtcccggtggacgggcggcccgggcgagggcgttctgcggtggtcgtgatcatcagtcctcggatcgcatggaaggtgggtccatccggccgccggctgccgtgcggcagcggtgcccggtgccagggatgcgtgaaccatgcgagaactgtccgtagaacccccgccgttgacccacggccgatgtcgctgcccgttgatcggcgatcactatatggcgatcaggagcatacgcatccagatctctgttcgaacgtaagtatcaagccacgatcggcatatgaggatgcgtcagtgccgggggacggccgtgggcggatcttgacgggcgccgcccgctgggcaaggcttccggcggacgttcgatcaaggcgacagcagggacggagtggtgatgacgggcccggtactcgctgtcgatcaaggcacctcggggaccaaggcgctggtcgtctgtccgttacgcggggtcatcggctccggatccgccccggtacggccccgctacctgcccggcggccgggtcgaggtcactcccggcgagctgctggactcggtcgtcgacgccggacgcgccgcactggccgcggccggcgagcccgtggtggcggtgggcctcgccaaccagggagagaccgtcctcgcctgggacccggcgaccggcgaaccgctgaccgacgcgatcgtctggcaggaccggcgcgccgaacagctctgcaccgaactggccccgcacgcaccggctttgcgggagaccaccggtctgccgctcgacccgtacttcgccgcccccaagatggcctggatacgccgccacctgacccggcgcggcgtcgtgacaaccagcgacgtctggctcgtgcaccgcctcaccggcgcgttcgtcaccgacgcggcgaccgcgggccgcacccagctgctcgacctcgacaccacgcgctggtcggacgccgccctcgacgccttcggcctcacgggtgagcggctgccggaggtcgtcgacgcggacacccacgtcggcaccaccaccgccttcggccccgcattgccgctgacgggcctgctcgtggaccagcaggccgcgctgctcgcccagagcgtcaccgagcccggcaccgccaagtgcacctacggcacgggcgcgttcctcctcgcccagaccgggtcgcgccccctgcgcagcacctccgggctcgtgggctgcgtggcctggcggctcgccggccggacgagctactgcctggacgggcaggtctacacggccgcctccgccgtgcgctggctcaccgacctgggcgtgatctccggcgccgccgacatcgacaccgtgggcgcgagcgtcccggacgccgggggcgtcaccttcgttcccgcgctcgccgggctcgccgctccgtggtggcgcggcgacctgcggggctcgctcaccggcctgggcctcgacaccaccgccgggcatctggtgcgggccctgtgcgacggtgtcgcggcccaggtggcggagctcgcggacgcggtcgccgccgatctgggcgccccgctcgccgccctgcgcgtcgacgggggactgacccgctccgcgctgctcatgcaggcccaggccgatctcctcggcatccccgtggaggtgtcggcgctgcccgacgtcaccgcgctcggcgtcggcgccgtcgcccggctcgggctcgatccctcgctcaccgtcgccgaagccgtcccggagtggaagccgtccgccgtctacgagccgcgggccggcgcggcgcaggcggcggagcgccgcgcacggttccgcgcggcggtctccgccctgctcgacgacgcaccggcatgaccggcaccaccggcggcgccgtcacgaccggcggcgccctgccgggcggggagtacgacgtgacggtcgtcggcgccggcgtggtgggcacggcgatcgcccgcgaactggcccggctcccgctgcggatcgccctcgtcgacgcgtccgacgacgtcggggacggcacctccaaggccaacaccgccatcctgcacaccggtttcgacgccgtgccgggctccctggagtcccggctcgtccgcgagggccaccggctgctctccgcgtacgccgccgagaccgggatcccggtggaaccgctcggggcgctcctcgtcgcctgggacgaggagcagctcgccgcactgccgggcctcgcgcggaaggccgtgcgcaacggccaccgctcggcccggatcatcccggccgaggaggtgcgcgcccgcgaaccgcggctcggacccggggcgctgggagcgctcgacgtaccgggggagtccatcatctgtccctggaccaccaccctcgcctacgcgacgcaggccgtccgcacaggcgtcgacctgcacctcaactgccgtgtccaggacatcacctcggacggaacgcgcaccccgaccacgctgaccacgaaccggggcgcgctgcgcacccggcacctggtcaacgcggccggtctgtacgccgacgcgatcgaccggctcctcggccacgcggacttcgccgtgacgccccggcgaggccagctgatcgtcttcgacgagctcgcccgcggcctcgtacgtcacatcctgctccccgtaccgggcgccctcgggaagggggtactggtgtcgccgacggtgtacgggaacgtactgctcgggccgaccgccgaggacctggacgacaggacggacaccggatcgaccgccgaagggctcgcgctgctgcgggagaagggccgccggatcctgccggccctgctggaggaggaggtcaccgccgtgtacgccggcctgcgggccgccaccggagacgaggactacgcgatccgggcccaccccgcgcagcggtacgtcaccgtgggcgggatccgttccacgggactgacggcctcgatggcgatcgccgcccatgtggtggaactgctcgccgagggcggcctgcccgtggcggggacccgggacctggtgccggtgcggatgccgaacctgggcgaggccttcctccggccgtaccgcgacgcggagttgatcgcgcgggacccggagtacggccgcatcgtctgccactgcgagcgcgtcacccgcggggagatccgcgacgcgctggcctcggcggtcccgcccggttcgccggacggcctgcggcggcgcacccgcgcacggggcgggcgctgccagggattccactgcggggccgccgtccgcgcgctgttcgaggaggcccgccggtgagccgcgcccgcacggtcgacgtcctcgtcgtcggcgccggccccgccgggctggccctcgccgcccgcctcgcccgcgcgggcgccgggcacgtcgaggtcctggagcgcgagcaggacgcgggcggggtgccgcgccactgccaccacgggggattcggggcgccccggcgcccctggctcaccggaccggcgtacgcgcggcggaccgcccaggcggcggtgacggccggggccgtgctccgtaccggtgtcagtgccacgggctgggccggcccgctgaccctggagaccaccggcccggcgggcctggagcggatcacggcccgcgccgtcgtcctcgccacgggcgcccgtgagcgcccccgcagcgcccggctcgtgccgggctcccggccggcgggggtgctgaccaccggggagctgcagcagtcggtccacctgtacggccaggacgtcggccgccgggccgtcgtggtgggcgccgagcccgtggcccgccatgcggtacggacgctgcgccgggcgggagcgcaggtggtggccgtggtcacggagcgctcccgaggcgccgccgtgccgggagttccgctgctcacggccacgacggtgggcgaactgcgcggccggggccgcctgtcgggcgtggcggtgcgtcacgcggacgggcgcaccggggtcctcgcctgcgacacggtggtcttcaccggcgactggatccccgaccacgagctggcccgccgcggcggcatcgccgtggatccggctacccgcggtccttccgtggacgcgtccttccgtacgtcggtgccgggggtcttcgccgtcggcaacgccctccacggcgtcgaatccgccgccaccgccttcgcggagggcgccgccgccgcggccccggtcctggcccgcctctcgggggcgccatggccggagcccggtccaccgctcgtcgtccgggccccgctggtgtgggtggtgccgaaccggctcacggacatcgcgcggcgccctctgctgctccggtcgggggagccgctgaccgccccggtgctgacagccgcccaggacggcagcctgctgtggcgccggcggttcccggtcaggatgccgccatcgcggtccctgcggctgcctccgggatggatggaccgggtcgaccggtcgggcggaccggtcgtcctcggcctcggctgacggcctcgacgtcccgcgccgagaccgcattgcgaaccggaacgcgctgcccgtcgtcctcccgccgccgggcggagcgcggaaccctcgacggcggctccgtcgcccgtggccgccggggtcgtccaccctgctcaactgcgtcgctcaccaggaatgttcgcttccgcgacgggtcgggccggaccattgaccagaggtcatatcacgcgccgcgaacgatttttgtagatctgtacgaagagtaggtttcagccagcggacgttttcatgtcttccgtccctgcctgactccgctcggttgcctgtgtactcctcacacacgatgcatcacgcgggggagaaaagccttgagcgagacgttttccggccgatcgccggcggcggacccgacccgcaccgcgctcgcagcggagcccgtcgccggcgttcggccgtagcgatccaccgcgggtaccgcctcctgcgccgatccccggacacccgggcgccgggcggtacccgcgagccacacccgtagcccctggtgcaccagggaacacccccaccgtctcctaaggagtgaccatgaccgcgcacacccaagaagccgacatccaggacctcgagcgcacctggctggacgaggcgatcacactggccacgaacagcgtcgcgaacggcggcggtccgttcggcgccctcgtcgccaagggcggcgagatcgtggcgatcgggaacaaccgggtgacctccaccctcgacccgacggcccacgccgaggtgagcgcgatgcgtgccgcctgcaaggagctgggcaccttctcgctcgaaggctgtgtcctggtgacctcgtgcgaaccgtgtccgatgtgtctctcctcggccctctgggcgcgcgtcgaccggatcgtcttcgccgccgaccggcacgacgccgcggtggccggattcgacgaccgcaagttctacgacctgttcgagaagcagcccgcgtccaagtggccgctggcggtcgagcacctggacctgcccaaccgtacggcgccgttcgacgcatgggtggccaaggccgaccgcatcgactactgagacccgtgcggacgccacgacgtgccggcggcgcacacacgaagtgaacgtccacgaacagcccggtcggcggcgccactgccccgtcgccgaccgccgagggtgcaagatgatgcggaccgaccagtcgtcctgaccgaggtgcgtccgcatgccccgcagcaccgacgatgaggccgggcggcggcacccccgcctcccgcgacgcatcggtacctggcccgccgtcggactcgcggtgaccgtgcttgccgccgccaatcaggccctgcaccgctggacgggcccgtggagcctggtgacggccgtcctggtcagcggtctgctgctcggtgtcctgcgctgggccggcggtaccctcgccgacgcgggcctggcccgggacacgtgggcccgcggtgcccgctgggcgctggccctgaccggcctggtcgccgtcgtctacctggccggggccctgctgcccgcgaccagggggctgttcgaggaccggcggtacgaggcgatggacggcggcgaggtactgctgcgggccttcgtgctggtccccgtcggcacggtcctggtggaggagatcgccttccgaggtgtgctctacggcctcgtgctccgggtgcggggggtcgtaggggcgaccgccgtgtcgagcgggctgttcgggctgtggcacgtgctgccgtcgctgcacctggcgaccgcgaaaccggccgtgaactcggtcgtcggcgactccgggctcggggtggtgctggcggtgctgggggccgtactgttcacggctgcggcgggcgtcctgttctgcgagctgcgccgccgcagcggcagcctgctcgctcccatgggcctgcactgggcggtcaacgcgctgggctacctcgtcgggtacctgctgcgctgaccggcggcgggacggactcagctcggcggcgagacgatgcccttcagctcgttcaggtcctgcgcggtgaatccttcgggccgcatgatgtccttccaggcgtcgacgtacgcggccttgtacgtgtggccgtggccgtccggaacaccggtcgagaacggcaggtcggcggtgacctgccagaaggtcacgaacggaatccagaccatggcttcgagcacgtccgagccgggccgctccccgatccagtcgggctcggtgaaggccaggttcgggctccaccagacgatcggatcggacgggtgcatcaggtagagcacccgcgggccgtcccacggccggtcggccggaggcgtcccggtggccgggtcgtcagtgaagcggaccgtccgcccctcccggtagacgggcccgatctcggggctgccggcgtcgcggtggtcgctgaactcgcggaacagcgtgttgaagttgggcgggccggcgaacacggtgccggcggtgcggttgcgcaggtcggcctccccgctgaaggccgtctcaccgccgaacgaccccaggctctcaccggccacgaacaggcgcgggcgccggtcctggggcagcttggaccacttgtcgtagaccgcgtcgaagagatcgcggccggccgcgcgcgccttggactggtccaccaggtacgacatccacgacggcaggtaggagtactggatcgccacggtggccgcgtcgccgttgcccaggtactcgaacgagtccacagccgcgggatccacccagccgctgcccgtggtggtcatcacgagcaggttctcgcgtgcgaagccgcccgcccgttcgaggtccgcgaccgcccgggccgcccgggtctccgtgtcgtcggaggtctccagcccggcgtaggcgcggatgggctcctgcgccgtacggtgcgtgaacgcgccgatctcctgggccgacggtcctccgtcggcgaacgcccggccctccctgcccagcgagtcccacggcaccagcgagccgggcccgcccgaacgcagcgccgaggtgggctggtgcacgccttccggggtctccgtgtcgcgcagcgagaaggcctcgttggacgcgttcacgaagccgttcagcagcagcccggagaacgcggcccaggccaggcccgccaccaggatccagccgaccacccgcgcggcgcgcctgccgatccagcgcccgagcaggtcggcggcccggtggtacagggcccggagcccccgcccggccaggagcaggagcaggaagacgagcaccgcgacgaacgggcaggcgacggtgaagaggacgttgtagtcggtgacccccatgagcagccggatctggtgctgccagtactggccgagcccgaacgagacgccgaagagcacgaccgcgccgacgatcaggacgagccacgaccggcgggaggcgctgcgtgcgtcccggtcggcgaaggcgcgccacacgtacgccgcgaccacgcccagcccgtagccgatggccgcgctgataccgcagatcaggccctggagtacgccgccgcgggggagcagtgacggagtgaaggacagacaggccaggaggagcgcgccccagcagccgggcagcgtcaggcggggcagcagacggtgttcgcgtaccggttcgtcctgcgcgggaggtaccggcgggtcctggttcatggcgtcctccacggccatggtgccccggctccgccggtcctgccatccagggcccgggccgtcattccgggccggtgggcgtgtcggggcccggcgccgtccactgtgctccggtgccccggcggaaggcggcgaccgcggcctccacggtggggaagaagtgccgggggtcgatggtccgggtgagttcgtaccgctcgatcttccgccgcaccgggtccttgagctcggcgaacacgaggtgcacgccgtccgcgttgagcgcctcgtcgagctcctccagtacgtcggcggccgtggtgtccacatcggtcatcggctccgccgcgaccacgatccagcccggccgcggatccgcggcggccagccgcctgacctcgtcccggaaggtcttggcgttggcgaagaacagcggggcgtcgaaccggtagatcaccaggcccggcagttgctcggcctcggggtaggaacggatgtcgtggtagccctccagaccccgcacccgccccagcaccgtgtcgtacggccaccaggcccgccggaagacgttcagtacggacaggcccacggcgatggcgatcccgggcagcacaccgagcagggccacgccggcgaaggccgcgaagcagagcaggaattccgcccgccgctgccgccacagccgtacggctcccggtacgtcggccagggacagcgacgcggtgatgaccacggccgcgagggccggctgggggaggttgcggaacagccccggagccagcacgagcatgaggacgatgagcgccgccccgacgaccccggtgagctgggtccgggcccccgcccgctccgccaccgccgtccgggaaccgctggtgctgacggggaagccctggaagagggcggccgccaggttggccgcaccgacgccggccatctcctggttgccgcggacctcctggccggtgcgggccgcgaaggcggacgcgttggagatcgtgtcggcgagcgacaccagcgcgatgcccagcgcaccgcccagcagcggtgcgaggtcggccgcccgtatgtcggggatcgtgaagggcgggaacccctcgggcagtacgccgaccaggccgacgccgtgctcgtccaggtcgaagacggtggcggcggcgatcgccaggaccaccatcacgagtaccgcgggaaccttcggcaggaagcgctgcaggatcaggatcagcacgattccgccgatgcccacggccgcggcggccgggacggtcgccccgtcggcgatcatccgcacgaggccggcacactcgccgatcaggttgtccgcctcgaccttgaacccgagcagcttgggcagctggccgatgagaatggtcagggccaggccgttcatgtagccgatcatcgtcggtttggagatcaggtcggcgatgaagccgagcttcgccaccgaggccaggatcatgatggccgccaccatgagcgcgagcatcgacgccagcgcgacggcccggccgggatccccgccggccgccacgagcggcagcacggtggcggcgatcatcggcccgagcgaggagtccggacccagcaccaggatccgggacggcccgaagaccgcgtagccgagcaggcagaggatcgtcgtgtacaggccggtgatcgccggcagacccgccagctccgcgtacgccatgccctgcggcaccagcagcgtggtcaggactactcccgcgaccaggtccttggacagccactcgcgccggtaggacgtcgccgcgcggattccgggaaccgcccggacgcgggagaggatcccgtggccgtcgtgccgggtggtcacggaccggccttcctcaggctgccttcgacctgcgggccacgagtttgcccaattcccatacgagcagcagcgcgagggcggccagcagcgcccagccgaactgccgcgcgtcgatctcggtcgtcccgaggatgcgctggaagccgtccagctgcgtcaccagcacggcgagcacgaactgggccagggccacccagttcatctgcttgctgtcgaaggtcgacggcgtcagcacggtgtccgtctcgctgcggcattcgaacgccgccacgatcaggcagagggagaaggccgtgaacgcgatcgaccggccgatctcgatgtcgtcgaagtgcctctcgccgagggtgatcaggccgagcaggaggatggtgaccgccagcccgcccagcccgaccgtgaccagcacggaccgcgtgagcaccgattccccgcgcggacgcggacggcgccgcatgagtccggcgctctcccggtcgaagccgagggcgaagccgaacgaggcgttgacgacgaagtggatccacaggacctgcggcggggtgaacggttcaccggcggcgatgttgaagacggtggccccgaggaacgtcagcacgaaggtgaccagcaggagcagcacgaaccggatgtacttggtgaggttgtcgtagatcgtccggccctgctcgacggcgtagacgatggtggcgaagttgtcgtcggagaggatcatgcgcccggcgttcttcgccacgtccgtgccgctgcccatggcgatcccgatgtcggcggccttgatggcgggcgcgtcgttgacgccgtccccggtcatcgccacgacctcgcccttcttcttcagcgtgttcgcgagcagcaccttgtgctccggggcgacccgccccaccacaccgatcgcctcgatgcgggcgagctgctcctcctcgctcatggcggcgaattcggagccgagcaccgcctcgccggggatcccgatctgccgggcgatcgccgccccggtggtgacgtcgtcccccgtcaccaggcggaccctgatgtgcgcggactgtgcgtcggccaccgcggccctggcctcctcgcggggcggatcgaccatgccgacgagactggtcatccgcagctcggtgacgtacgcgagcaggtcgccgtccggatcgaagccgtccgggtccaggtcacgcatggccgccgccatcacccggcgcccctcgccgcccatccgctcgctctcctcctcggcccggcggagcagaccggcgtcccacgggacggtctcgcccgccgcgagcgcggtggcggcccgggccatcaccgcgggggccgctcccttgacgaagcagcgcacgacctgccgcccggaggcgtcgaccgccgagtggaaggtggccatcagcttgtactcggggtcgaacggcagggtggcgagccgggggagggcgtcgcgggtggcgtcggtgtccaggccggccttgtgcgcgaggaccaggagcgcgccctcggtcggatcgcccaccaccgcgccgcccaccagcttggcgtcgctggccaccacgtacggcaggatcgcgtcctcgatccccgcggtggacccggcggcgtggtggaccttcccttcgaggccgtagcccgtgcccgacacggtgtaccggtcggtggggctcaggacctcgacggcggtcatctggttcatcgtcagggtgccggtcttgtccgagttgatcgcggacgtgaacgccagcgtctccaccgacggcagctccttgacgatggcgttccgcttcgccaggttcaggctccccacggacaggatcgcctgggtcaccgtcggcagggcctcggggatggcggcgatggccagcgagaccgcgctgacgaacaggacgtcccaggcctggtcccgctggcgccccagcgcgaacatcacgatcatggtgaggcccgccgccgccgtgatccacagggtcagccggtcgagttccctggtgagcggcggcacctccttctcggtggccgacagcattccggagatcttgccgagctcggtggccgcgccggtcgcggtgacgaccatgacgccgctgccgtgggtgaccggcgtgttcatgaacgccgtgttggtctggtcgcccggcgacagccggctgcccgccagtgggccggtctccttcgccgcgggaacgctctcaccggtcagcgccgactcgtcgatctgcagggcgctggcctcgatgagacgtccgtccgccggcacctggtcccccgcggagatgagcacgacatctccgccgacgagctgttcggcggggacctcggcctccctgccgtccctgcgcacccgcgccgtcgccttcatcatcgacttcagcgcgttcatggcgctctcggccttgccctcctggcgcaggcccacgaccgcgttcagcagggtcagcacgatcagcaggatcgcggtggtccactcctggatgaccagcgagacgatcgccgccgccaccaggacgatctgcatgtaactgcggtactgggcgaggaaccggcgccaggccggggtcggccgctcctcgggcagcgcgttgggaccgttcgccgccaggagttccgcggcgcgcgccgcggacagcccggccgcgggatcgacaccgaacgccgccacgacctccgcgggagagcgcgcgtaccagccgtcaccggcagcccggggctgttcggccagggaatccgaccgcaccgtcatggttgtgcctccgatccggggccgcggacgcgtccgcgccggtcacgcgccgtccgaggaccgccggccgcgcttcttgccaggcttgccgccccgggcggtgtacggatcggccgcggcgccggccggggcctcccgctccaggccccgtttcgtgacgaggagatccttgcgggcctcctccccgacgtcggggtactgcggatcgatgtccatcagggtgtgggcgaggaccgccgccgcgcagatccgggcgaaccacttccggtccgccggcacgacgtaccacggcgcccacttggtgctggtggccgacagcatctcggagaacgcgtgctggtactcgtcccaccggcgccgctcccggacgtcggcggcggagaacttccagttcttctccggcaggtcgatccgcttcaggaagcgcgtgcgctgctcctccttggacaggttcaggaagatcttcaccatcttgaacccgttgtccgtgaggtagcgctcccagcggttgatctcccggtagcgccggtcccagatgtccggcccgagcacgtgctccggcagcttctgccggagcaggacctcggggtgcacccgtacgacgaggacctcctcgtagtgcgagcggttgaagatggcgatctcgccgcgctggggcagccgccgggcgtagcgccacaggtagtcgtggtcgagttcctcggaggagggcaccttgaagctgctgacccgtacgccctggggattgacgccgctcatcacgtggcggatcgtgccgtccttgcctccggcgtcgagcgcctggagggcgagcaccacgccgtacgtgttctgggcggccagtcgttcctggtactcggcgagcagcgacaccccggtccgcaggagctcggcgccgtcccgcttcttcattccgcccttgtagcgggggtcgaagtcccgttccaggcgcaccttcgagcccggtggcacccgtagcggctcgatgaaatccgcgatgcgttcggctctcttgtcggacatcagggcgcgcccctttcccggcccgcggaggtcacggccctttccccgccacgtcctgggtgctccccgtcgggagccctgcgtgaccggcggcggcgagcgctctccgggaccggcgctcggccaggatcgggacgtagaccctgaccttggcctgccggaacgagtcgtaggcggccctgacggtcgcttcgacggtgtccgcgtcgaccgaggggtaggccgccttcagccgcgccacggtggtccggacggaggcgagttcctccgaggcgggtgagcgttcgtccgatgtccgtgccccgggatcttcgagggcggggacggtcccggtccgttccgcgccctggagtgttgcaggtgccatgtcccacgaccttcggaccgccgatgcgagcatgccgacatcgggtgagggtgcccctcatggcgattctctgccaaaccggacaagatcgctcactgtggggcgggagcgggcgagatccgaaagagacggcctaacagccgcccgggcccttggaggcggtgccgcattcgccgccgccgcgggcgacctccgtgcagagggtggcttcgaccttgcccaggaggcgggccagttcggcgcgttcggtggcgtcgaggccgtccagcgtctggcgttccagctcgccccatgccctgcggacctcgaccaggagtccatgactggcgtccgtcgcctcgaccagggaggcccgtcggtccgcggggtccggacggcgccgcacgtggccggagtgctccaggcgctggagcatcttggtcaccgtcgaggggtcgaggccgaccgctctgatcagctcggactggcgcacggccccgttgtcccagaggtgcatcatcaggaactcctgccccgggtgcagtcccaggtcccgcaggacccggcccgccgcgatccggtggagccgggagacccggctgatcgcatgactcaccggcccgtccagcaccgcgctcggcgccgccgtgcactgcacggcggagcgcggctcctgtacggattccgcggtcatggaagtgctcctcctgggtcggtccgatggatctccggggttccgagtggattctaccttccgcccccattttctcttggtcggccaagcaatggggtacgctgcatctcgcagcaatcattggccgaccaattgtttttgtggggtagacatgaccagcgccttcgaaccggtccacgtggccggcgcgaccctctccaaccggatcgccctcgccccgatgacccgcagccgcgcaggtcagggcggcatcgcgaccagcctcgtcgccgagtactacacccagcgcgcgtccgccggtctgatcatcaccgaagggatccagccctccgtcgtcggacagggctaccccttcacccccggcctgcacaccgccgagcaggtcgcggcctggcgtgaggtcaccgactccgtgcacgcggcaggcggccggatcttcgcccagctgatgcactccgggcgcatcggccacccgtcgctgctgcccgacggactcgtccccgtggccccgtcggcggtggccgcccagggccagctcttcaccggcgacggcatgaaggactacgtcaccccgcacgagctgaccgcggccgaggtgcggcagaccgtcgccgactacgcgcaggccgcgcgcaacgcggtcgaggccggcttcgacggcgtggaactgcacggggccaacggatacctgatccatcagttcctggcccccggctcgaacctgcggaccgacgagtggggtggccccgccgagaaccggatccgcttcgcggtggaggtggtcaaggcggtggccgccgcgatcggcgccgagcgcacggcgctgcgcgtctcgcccggcaaccagtacaacgacatttccgagcccgacccgcagcccgtctacgaggccctggtcaaggagatcgacggactcggcctggcctacctccacgtcatggagcacggccccgcggcacgggaggccacgctcgccctgcgcaagcagttctccggaccgttcgtgctgaatccggcgacggagggccccaccgaccaccgtgccctctcgctgatcgaggacggcgtcgcggacctcctcgccttcggagcgctcttcctggccaacccggacctgccggagcgcctgcgcaccgaaggcccgtacaacacccccgaccccgccaccttcttcggaggcgacgcccgcggctacacggactatccgacccgctagggggtgtcttgccccctgtcaccgcggggccggacggctccggcagtatggcccggtgaaccccgcgaaccccgtaccccggtgccgtgacagcgcggcctccgcctgccgccgacggacccggctgctggcggccggggccgcggtggtgaccgtgggcgcggggctggaactgcgggccgtcgcgacggggagcacggccaagtacggcggagacgccctgtacaccgtcctgctgctgaccctcgtcgtgctggtcgcgccccggctcacgccgctgcgggcggccgtgaccgcgctggccgccagctgggccgtcgagttcctccaactgaccgccgtacccgcggagctctcgcggcacagcaccgtggcccgcctcgtcctcggttccaccttcaacgcacccgacctgctctggtacgtggtcggcgcggcggcgggcctgctcctccacaccgcgctcagaccgtccgcaccggccgcggacacgtacccgacacggccgcggcccgagaggacgggcgggtgagcggggcggcccgtcagcggggccggcgggcgctgttcaggcgggctgcctggcgcgtcagatgatcgcgctcggcgaggttgggcgccttccgggccgcctcggcgtacagccgggccgccgtcaccacgtcgccgtcgcgctcgtggaggtacgccgccaccgcggcgtggcggggcagcgcggagtccagcgccgcgagcgccgccagcccggcgcgcggcccgtcggcctcgccgacggccaccgcgcggttgagccgcacgaccgggctgtcggtcaggagcgcgagctcgtcgtaccactcgacgatctgcacccagtcggtctcctcggcggtgggcgcgtcggcgtggagcgccgcgatggcggcctgcgcctggaactcgcccagccggtcgcggccgagggccgcctgcaggatccgcacaccctcggcgatcgaccccgtgtcccaccggccgcggtcctgctcggcgagcggcaccagactgccgtcgggcgccgtccgggtggcacgccgggcgtggtggatcagcatgagggcgagcagcccggagacctcgggatggtcgacccgggcggcgagctgccgggtgaggcggatggactcggccgcgaggtccacatcgccggagtagccctcgttgaagaccaggtagaggacgcgcagcacggtggcgacatcgccggggcggtcgaaccgtactccggagacggtgcgcttggcccggctgatgcgctgcgccatggtcgcctcgggcaccaggtaggcctgggcgatctggcgggtggtgagcccgccgacggcgcgcagcgtcagcgccaccgccgacgacggcgtcagcgacgggtgcgcgcacaggaagtacagctggagggtgtcgtccaccgcggcagccggccccggcgccggctcctcgtccacgaggtcctcgcgccggcgccgggcggtgtccgcccgggccgcatcgaggaaccgccgccaggccaccgtgaccagccagcccttcgggtcccgcgggggatcggcgggccaggtgcggaccgcctcgatcagcgcttcctgcacggcgtcctcggccgccgcgaagtcggctccgcggcggacgaggatgccgagcacgcccggcgtcaggctcctgagcagggactcgtccatcggtgaggtcactcggtgatggtgggcggcgcgctcaggaacggacggagttcgagccattcgtggatcggctttccccccgccccgggggcggccgacagttctccggccagttcgacggcgcgctcgtagctgtcgacgtcgatcaccatccagccggcgatcaggtccttggtctcggcgaacgggccgtcggtgaccggcgggcgcccctcgccgtcgtaccgcacgaaagtcccctcgggggcgagcgcctggccgtcgacgaactcgccggttccttcgagccgggccgcgaagtcgtgcatgtactggacgtgcgccgagatctcctcgggcgtccaccggtccatgggcacgtcgttgaccgctgccggggcgccgcggtagtgcttgagcagcaagtacttggccatggtgcttctcctcggtgctggtgcgacccattgtggccgccttcacccctgggacggagccggccacgggttctcgacatccccgtccgaggttttttcggcgtcgggatgcgcgcgtgatccgccgaatgcgcgcggaatcagcccatccggttatctgggtcccgaggggttccgcggcgcattccgcaggcccgccgaggtcggagggccaccggccgcgcgggggtggaacgggtggagcgccaggctcaggccacgcgcccccgcacgcctcccgccgtgacgttccctcacagcggtaggtgggcagccgcttgatgctgatcgatcgtctcgtgaggggaagcccgatgaccaaggtcctggtgctgcacagcgtgtgcctcgtgaggtcggccctggccgcgctcctcagatccgaaggcgacttcgaggtcacctccgccggctggcgggccgccgcgcggcaggccgaattcttacgacccgacgtggtcgtcgtcgacctcgactgtccgggggtctcggccgccctcgcggacgcgggcgccgaccgcctgctgcccgaggcacccgactcctcgcccctgctggtgctcgcccgggccgacctccccggctcgctgcggcgtgccttccggacccaggcgctcggctacgtggacaaggacggctcgcccgcccggctggtccgggccatcggcaaggtcgcggggggagaacgcttcatcgacgccacgctcgcctcggccttcatggaggccgaccccgtgccgctcagcccgcgcgagctgagcgtgctggcccgggtcgccgaaggcgactcgatcgcggagatcgcccgcgccctgcacctcgccagcgggaccgtacgcaactacatggccgccgtgacccggaagaccggcgcccgcaacctgatcgacgccatacggatatcccggcgggccggctgggtctgagccgccggcccgagcacccccggatcctccctcacccttgcgcgttccacaggcccaccagatcccggtacaggggcgacctggccgggagctcggcatgcgtgccgcacaccgcccgggtcccgtcgagaacgaggacccggtcggccctgacggcggaggagatgcggtgggcgaccaccaccagcgtgccggggcgctccgcgagcgcccgctcggcgcgttcctcggtccgcgggtccaggtggcaggtggcctcgtccagcaacagcagcggggcgggggagagataggcggcggtgagggcgaggtgctgccgctcgcccggggtgagccgacccgggtcgagggccgcctccaggccgccgagccgggccacgagcgcgtccgcgccgaggacggccgcggcccgctccacctcgtcccggggcaccggaccggggcacaggtggctcaggttctcgcggaccgagcccgtgaagacgtacgcctgctggggcagcagtgtccggcggacgtcgggggcgtggccgggggcgccgcgtgcgggggcgcccgcgacccgtacggttccccggccgggcggcagcagaccggcgatcaaggcggtgagggtggacttgccgataccgctcggcccgacgacggccaggtgctcgcccggcccgaccaccaggtcgaggccgtcgatcaccgggtgtgcccggggaccgtaggcgaagcggacccggcggagttcgacggcgggtacgggccgtgcggggggcgcgggtaccggccccgggtccgccgccgggggcacggagtccggccgcggggccggtcgttccggttcgcagaaccggtcgagcaccaccagcagccgggtgcccgccgctcccaccgccgtcatcagcgcgtccagggcgggcagcagcgactgcacgagataggtcagggccccggccacggcccccgcgctcaccccgcgcccgagcagccagggcgtgccggccagcagcgcgacgaccggcagtcggcccgcgacgcccagggccaccgtccgcagggcggtccagcgcgcgaggcgcccgccgagccgctcctgctcggcgatcagccgctccaccccggccccggcactcgccccgcccccgcaggcgacgacgtcgcgcagccccgccgccagttcgcccgcgcgcgcggacagcgcctcgtcggtgtcgagcgccgcgcgctgcacgcgggtcatcgggcgcagcgtggcgaggaaggcgcccgtacccaggagcagtgcgggcaggaccaggaccagcaggacgggggccagcgcggccagcccgagcagcgcgcccagggcggtgaagacgaacgaccgggcgaccagcaccagcccggcgaaggagtcccgggccatctcggtctgctgcgtgagccgggagaccgcacccgagccggggtcccgcccgggagcggcgacggcccgcccgatcgcctgccgtacggagcgccgcaccaggccgtcgcgcaggggttcgaccaggtccgcgagcccgccgaacaccccgcgcagggcgagggcgccgagcagggcgcccgcaccggccacggccagccagccgaggccggtaccggtacggccggcgaggaagccgtcgtcgagggcgcgggccaccgcgtaaccgccgaggaaggtgtgtgcggactccagcagggaccagagcgcgagccggcgcagcgtccgggtccggccgcgcaggaagcggcggccctcgcgggacacccggcgccaggtgccgtactcgctcatcggaccgcctcccggccgggcggttccgcggccgctaccgggcccggctcggccccctcgccgaacaccgcccggtagtcggggtcccgccacagctcggtgtgcgtcccggtcgcccgcacccgtcccgcgtcgagccatacgacgaggtcggcgccggcggccgaggagacgcggtgggcgacgacgagacgggtccccggccggacgtcgagagccagcgcacgctccacctcgcgggcggtgcgggtgtccaggctcgatgtcgcgtcgtccaggacgagcagccgcccggcacggcagaacgcccgtgccaggcccaggcgttgaagctccccgccggacagcggcgcgtccgtgagcgccgtgtcgtacccctcgggcaggcggcggacgaaggcgtcggccccggccgcccgcgcggcggcgcgcacggcctccggatccggatccggcccgccgaaggcgatggcggcggcgacgctctccccgaagagggccggccgttcgaaggcgtggccgatctcgcggcgcaactcctccgcggacagctcgtcgaggggcacgccgtcgagcaggacccggccctcgtcgcacgccgtgagccgtcccgccaccgcggccagcgtcgtcttgccggagcccgagcggccgacgacggcggccgtcgccccgccggggatccgcaggtcgacgtcgtgcagcagcacggtgccggcgcggacgacccgtaccccgcgcagctccagcgtgcccggcccccgctcgggcaacctgcgtacgccctgcgggagttcgggcagttcgaagaggtccgcggtgcggcgggcggcggcccggccgcgcaccacggccgccagccgccccgtcaccgcgccgaccccggcggcgaggcccgcgtagcgcacggcggcgaggagcccgccgacgccgagcgccccctccgcgaggcgcaccccgcccacgccgaggaccacgtagagcagcaagggcatgagggcgccggtacgcgccaccgtcgcgccgtagatccgccacgtacgccgcccctcggcaccgagctccggcaaccgggccagtacgcgcgcctgttcgcgctcggccgtgccggcggcggcgatggtgcgggcgcccccgagtgcctccacgaggcgcccggccagggcgagctgcacctcctggtagcggctgacactggcgcccgagtcgcgggcgaacgccctcagcagcagggcgagcagcgggagtccggcgaggaaggccagggcggtccacacgtcgaccagcatcagcgccaccagtccgccgagcggggggagcagggccacggacgcggtgacgacggccgccggtacggcacccgcggtggtggcctgcgcggtcagccgggcggagagctcaccgggggagtggcgggccgcgtggtgcggcgcggtgcgcagcagccggccgagcccgagccgccgcagccaggcggtggagcgggcgtcgacaccgccggtgagccgggccgtcgccgcgtcgaacaggacctcggcggcgatcaccaccgcgcaccacgcggtccaccgggcgccgccggggtcctgccgcagcaacaggtcgagggtgtggccgaggaccgccggctcggccagggccgcgcccgcggcggccaccgagcaggcggacgcggcggcgagccggccggcgctgtgccgggcggccgtccgcagcgcccggtcggccgcgcgggcggccgtcgcctcgccggggggatcgggcgcggtcatgggcgcgggctccaagggtgtgttgcgggcccgggcggcgaaccgcccgggccctgaggacctgatccccgatcagttacaggtcgtgatgctcaggctgctgtcgccgcagaggagcaggctggcgcggcttccgccaccgtgcgccgcctcggtggtctcttccttgggggtctccatcgactgcaggtcgagaagcgtcatgtccgtatcctcttcactgtggtgttccgatgggtcacggcccccgtgacggggaccggctctggggccgccgcggccgaccgcggcggcgggaggaacggcaggtgcgcgcgcccgtcgggcgccgtgctgccgagggcgaggagcgcgccggccgtgcccgtggacaggtccatggacaggcgcatcatctgctcgccggggaaggccaggaagccgcggtaggggagcgcgtgccgggccagggcctccacctgccgggcgatgtccgcgggggcggagcccgggccgggcgtcgtggtccgcgccaggtggaggatcatgccggccgcgccgcggaacaggccgggctgggcgtagaaggtcgcctgcgcggcacggacgatctccggccgggcacgttcgaagcggtcgtcccgcgcgtgctccagccagtcgtccagcaccgcgccgatccctacgctgccgcccccgaggtagggcatcgtgcgccagccctcgtcgacctgaagggtgccgaacgcgctggtcacgcagtggtcgagatcgcggtgcagggcccggccggcccggatcaggaactcctggtcgcgggtgcgttcgtagagccgcagatggagcagcgcggggccgctgtgaccgtggagcagaccggcccgcttcgggccggacgtggtcgccgtcccggcgaggaggtcggcgcagcgcagggcggcggtgcgcagttcgccctcgccggtggccgagcccagggagtccagggccaggccgatgccggcgagaccgctgtgcagatcaggtccggccgactgccagggctggtccagcagtcgttcggcgagggcgagcgcgcggtcgcggtggccgagccgttccagggtccaggccagaccggcgaggccgtcgtagaagcccagcggcatgccggaggccggttccttcgtccggtccagcagccattcctcggcctcgggccagggggcggcgccggtctcggcgagcgcgtacagcacaccggccgctccgtggccgaacgcggttccgccgccggcggtcgcgaactgggccgggtccccggggaagaggcggtcctcgcggtcgaaggtggcgctcgcccggatcgccgccgtcatcgaggcacaggcggcctcccggtcgccgggctcgaccggcaggtaggggcgggtgcgggggacgaccgcgcgagcgccggtacgcgggcccggaccgggccccggatcagggccgggaccgggaccggacgccgcgaggatctcgcgtacggcctcgtcgaggaactcgcggggcacggggaactgctcggcggcgatgtcggccaggtgcgccgccttggcccggtccagcaccagcaggctggtcagcggcaggaacagggccagtcgcaggcaggccagggcgtaccggtcgacggcgaaaccgcgcagaccggccggggcgacgaacgccgggttcgcgacggtctggcggagcccctcgtccacgtgggcggcggcctcgaagtcgagcagcgcgaccgacgccccaccggtccgctcgtcctccgcgaccatgatgttgaacaggtgcaggtcgttgaagacgatgccacgggcgtgcaccgcctccacggcctgcgtcaccccccggtggacctccagcgcccaccgggtgtactcggcgagctccgcgggatcggggtccgcctcgatcagcgggtgccggcgggcgaagtaggtgttgaggggcttgccctccaagtactgcatcaccaggaagtggtggtccccgaccgtgaaggtgccgtggaccgcgggtacgcagtccagcccggccaaccgctccagggccctgcgttcgcggtgcagccgggtcacggcgtccgcgccgtcggccgcgagccccgcgaaggggcgggcttccttgaggacgaccggctcgccggtgcgcacgtcgcggccggcgtagacaccgccgccgttggagaagtgcagcgcccgttcgaccgtgtacggaaggccttccagcgtgacggcggcccgccgggccagatggggcgcgaggaacgcgggcaacccgacccactcgggcggctggaacaccggacctcgcgggtccggcacgagccggccgtccgggttctcgatcgccgggacgagctcgccgcggtcgtcgtagcagtgccgcagcgtgaaactgccgtaacgcaggtgcacgggcccgtcgttccagcgcaggtcgctcaggatgtacggaccgggctccccggccagcagcacgtcgagctcctcggcgatccgccggcactgcgcctcgtccgccgggtacacggtgaggaacttgccgctcgccgcgcggtcggcgtacttcgcgttgcgcaggtgcagcagataccggctcggcacgaacttgaacgcgatccggcgctccaggcagtacgcgcggacccgttcgaggacggactcggcgttgtccaggcacgccgagacgtggatcttccagccctgggagggaagccgggcgtcgacgggcctcagcgccaaccagtccccgctgcggtgtgtccgccaccccgccggtacgggggcgagcgcggccgggtagttctcctcggtccgccggtacggcgcgtcgtagaaccagcggtcggcgtcgcagaaggcggcgtaccccttgttcactcctgctccctcggtcggtgacgtgtccacgctgtcacgcggcccgggagccgcgacagtcgcggctgtcaccgacggggtgtgcagtacgcacgagtcacaaagcggcggaagggggtcggtgggtcagtccttgctcgccgactgccagctcatgccccagccgtactcgatgtccgccgcctgctgcttgaagacgccgggcgctggcaggaggtacttcgcctcccgccggacgatcagctcgccgcccacgttctcgatcagcgcgatcgccgccaccggcgacgggacggtgcactcgtccaggcgcacctcgatcggcggaccggcgggcggatggagggtggcgaccccttggagcccggcgaagctggtggccccggcgtagatgaccacgaagaccagcaggcgctcgatctcggccgcgtgatcaaggttgatcatgagattctcgccggcctcgctggcaccggtccggtcgtcgtggtccagctggacgtagggcgactggtggaacgagccgaactggttgtcgatggggtggacgatcccccgcgtgccgttccgcagctcccacaggcaggacaggtcgaggtcgatgtcctccagtcggacggcgccctcgcccttgcgcatccagccgcgcggcggcgcggcggcgctccacgtcagattgacccgcatgccccccgaggtggccccctgcttggtcagcgacaccgcgggggcggccttcgtcaaggtgatcttcgacagccgcaccggcggggtgggagcgggcacgggagcgggtgcgggcacgggagcggccgccggccgggccggggcggccggggccggggccggggccggatcgtcgaccgtgatcccgaagtcggtggcgagcccggccagcccggaggcgtatccctggcccacggcccggaacttccacgcgccggcccgccggtacagctccccgagcacgaacgcggtctccgacgtcgcgtccgtcgcctcgaaccgcgccgtctcggcgccgctccgcgcgtccagcacccgtatgaagaggccggacacctgaccgaacgtgccgtccgtggaagccgcgagcaccacggtcccgatctcctcctccaccccggacagcgtcaccccgatcgtttcgagcacctccgtgccgtcctcgcgccggccctcgtggcgcacggcgccactggggtgcacgggctggttgtagaacacgaagtcgtcgtccgaccgcaccttgccgccggccgtcagcagcagggccgacacgtccacgtccggtgctccgggacctcctcgccagcccagctccacccggaccgtggcactcggcaccggtacgttggcgcccttgcgcatggacatgcgaatcccccctgccgctgcttcagtcccagttcccgcagcgtacgaggattcggcccgctcccctccccgaaggcgtcgattgcctcgggcccggggggggaaaagccgtggggccgtggtggcccggcatgatggggaggtgatcaccattcatctgaagtacgagatcgacgtcgacaagctggcggacttcgaggagtacggccgccgttgggtccggctggtcaaccggttcggaggcacgcaccacggctacttcctgccgagcgagggcgacagcgacatcgcctacgccctcttctccttccccggattcgccgcgtacgagcggtaccgcacggacagccagaccgacccggagtgccaggccgccttcgacctggcccgcgagacccgctgcatcaagcggtacgagcgccgcttcctgcggccgctcgacactccgggttcggatacgtccggctccggcacccccggcctctgacacgtccggaccggcgcccgggtacggcggccggtggccgccggtccggaccgccccgcgaggtcatctcacgcgtcgcgctccaggacgcgacgggccgcctccgcctcggccgcgggtggtgacagttcgtcgagcgtgtcgagctcgtcgtccgaggccagctcctgctcccaggcggccgcgagccgctcctgctcctcctgcggtctgccggtgacggcctcccgtcgctccggtcccagagccgcgaggaaacgcccgaccgcgtccgtcggcatgccgtactccttctcgccggtggggagggcggcggcgatcgcgctgccgcgcccggcccaggatggcgaaccgcgtcggagcgggcggcccgacacggcgggccgccacccgaatgcccgcgaacgcggcggcgcggaggccgccgcggacgtcacgggcggcctgcaggatgggccccgcggcgaggccgacgccggggaaggacgacagggtgccgaagggtgccgaccgctgagcgtgctcgaacgcccggctgaccaccgccatggccgccgggaccaggagcgcggctccggtcaggcgcgggcgaggaccgccacggcgttgtgaccgccgaacccgaaggagttgctgatggcgaccgacgacgggtggttcctggccgtcccgccgacgacgtcgatgtccatgccggttccggtcgcgcgcagccccgcggtcggcggcacggtgccctcggccagggcaaggacggtcagggccgcctcgatgacgcccgccgccccgagcgtgtgcccgagggtgcccttcgccgaggtgacgggcggccggtgcggcaggacccgccgtaggacggcggcctcgatgtcgtcgttctgccgggtcgacgtgccgtgcgcgttgacgtggccgacgtccccggggcccagatccgcgtccacgagggcggcgcggacggcctgttcggcgccgcgcccctccggatgcggggccaccaggtgatgggcgtcggtggtggccgcgtagccgatgaggcgggcgagggggcgggccgcccgggccgcggcgtggccggggcgttccaggaccagcgcgccggcgccctcggcgatgacgaaaccgtcccgggtgccgtcgaagggccgtgaccccgtatcggacagggcgcccaactgggcgaatccggtcacgttcagccgggtcacgcccgcctccgagccgcagacgatcgcgatgtcgcactgtccggtcgcgaggaggtcccgggcgaggccgagggccgtggtgcccgaggcgcaggcggtggaggtgaacagggccggaccggtcaccccgaagtgcagggcgatgttggcgcacatcatgttggtcagatagccggtgaggaagtacggcgagacgaactccggtccgtgctctaccagtcgggcctgcgcggtctcctgcgtacgcgccccgccgaagccgccgccggtcacgacggccacccggctgccgtcccagtcccgcggatcgagcccggcctggtcgagggcctgcgccacggcggccaggccgaagcgggcgaccggatccagccgggccccgccgcgccggcgcagcacagggtggtcgagctccgggacgcggcagctgagggtgacgggcagaccctccagggcggggtcgggcgacgcggtggagcggcccgcgcggacggccgaccaggtgccgtcccggtcgcagccggccgccgtgaccaggccgagcccggtcacgacggcctcgcggcgacggctcaacggtccgtccgccgcgcctcgacggacgcggcgaacccggcgagggtcgcgtcgcgcagctcgtcctcgccgaccttgacgcccagcacctcgtgcacggtgatggccatctcgacgaccatgagcgagtcggtcagcaggtcgcgcatgagcgcgtccggccgtacctcgtcggaggggacttcgaacctctcgacgagcagttcactgatcacgtcgaggacggattccggcgcggaagtggtcacaaggggctctcatttgcggtatcgaggccattgcagcatggtggcgcaaaagccggggatggagtggggcgaagaagtgatgccccgatgtggggcgttctcgcgctcaaatacctatcacgacagggtatttacgcaaaaccagttccacatcggcttcctgatgattcgaaagatgagagtggggatcatttgtgtcggaaagtttgactgatgtgatcgaggtgctcggggcggccggcgccgaactcaggaacgtgaagcggctgctcggggatgccggggagaacgcctgggaccagctcctcgactggctggtcgacgactggttccggctggacgtgctggggctggagaacattccggcggacgggcccgcggtggtcgtagcgaatcactcgggcgcctggggcctcgacgccttcgtcctccagaaggtcttcgcgcgcagcctccggcgtcccttgcacatccccgccgccccgctggtattccgtttcccggtgatcggctcgtacgcgcgcaaaaacggcgcgattccgctcgatccgctgctgggactggaacacctgaacgccggtgaactcgtcggcgtgttcccggaaggaatctccgggctggagaagccctttcgcaagcgctaccggctccgccccttcagtcccggattcgcggtcaccgcggtccgggccggagccccggtcgtaccggtgtccgtcatcggagccgaggaggcctgtccccggatgggggagatcccggccctggcgcgtttcctcggcctcccctgcttcccggtcaccacggtcttcccgctgccctcgaaatggctcgtcaccatcggcgagccgatccccgcaccgccccggcccgagtccttcgccggccgctccgccgcggcccggcggctgtgcgccgagtcgcagacagcggtgcagaccctggtggaccgggaacggcgcaagcgggacacccccttctggtagcgccgccgcggtgaccgggccggccggcggttcagccgtcgccctcggtcaccgcccgcaccccgggccagaccagggtggtcgagccccaggccagcccggccccgaacgcggtgagcgccacccgctgcccgggtaccagctttccggcggcggccgcctgggccagcagtaccggaaccgaggcggccgccgtgttcccgtacgtcccgatgtgcgacagcacctgcccgggagccagtcccagctcgtcggtgatgccgtccaggatgcgctggttcgcctggtgggcgaccaccacgtccagctcgccgagcgaccaccccgcccggtcgagggcccgcgtcagcgaatcgcacatgccgacgaccgcctgcttgagcacggcgggcccgtccatccggaagtacggcgaggcctcctccccgtcccgctccgccgaccgccgcttccgggcccgcgagccaccgccggggacctccaggaggtcggcctgcgatccgtcgctgcccaggtcgaacggcccgaacacgccggggccgccggcggtgccggccgcgcccgcgcggagcagcaccgcgcccgccccgtcgccgaagatcgcggacatcagccagtcctgcggatcgaggaaggcgctgaacacgtccgaggcgaccacgagcacgctgtcgcaggtcccgccggtgatcatcgcggacgccacgcagaggccgtacaggaacccgctgcagcccgccgccaggtcgaacgccggtacggtgcccagccccagccgtgccgcgacctccggggccccggccgggagcagccggtccggggaggtcgtcgcgaggaggaccgcgtcggccccggacgccccggcggccgtcagcgcgtgccgggccgcccgtacggccaggtcgacggtggcctcgccgtcggcgatgcgccggctggccacgccgatgcgctcgcggatccactcgtcgcccagcggccgccgcccgcacagctcggcgttggtcagggcccgcggcggcacgtaggcgcccaggcccgccaggaccgatgtcctcatgtgaccgtccacctcagcgcgccagccgccgggcggcccggcggacgtcctcggcggccctcgcgcaccgttccgcgtgcccgagcaggaccatccggaagcgctcgcccgcctcgtcccggttccagccgccgtggtcggcacaggccgcgagcgactccgcgtgccgctccagccggtcggcgctggcgtgggccagcgcgccgtacgacgccggggcgtagccgtacgccgagaccggcacggccgtcgccgtgccgaccgtcacccgcccgtcgcccgcccggccgtgacggccgtcggggccgtcgtggtcctcgccgtccacgggatcctggatgtcctgcagcgccacgagcagcgtccgcgggtcgagcacgtccggcagccggtcggccgtgaaccccggtgcgatcagcaccgggcggacccgcgcggtgacgacccgtacgaccccttcggcgacgagcgccgcgaaccgcgccgccccgcaccccgccggggatccgcacagggccagggggcccgggtccaggtccggaccgcccgtgtcgcccggaccgcgcagccaggccggtgcccgcaggatctcggtccccgccccgatcgccaggtcctcccagacgaacggcacccgcaccggatagacggcggcggccaccggcggataccggcgcagcgcctcgcccacggcgtcccggggggacacggcggcgcccaccgcgaggagggccagcgcctggagcgcggtaccggccgcggcctcggagaccagcgcgagggcgtgcgccagagccggtgcggccgcgtccggaccggcgccccgctccatcagccgcccggccagggcatcgggatccgggtcggccaggtgcaactccagccgacggcgcagcgccgcgtacccggactcgtaggaccgctcgcccgcggccgccgtcgcgaccgcggtcacctcgctcagcagggtgtccggggcggccccggcgcccgccaccactcggcggctcagccgcagcatgccgcggcaccactcgtgccactccagcgtgccgtccccgcggcgggccgcgatcgccccgtccacgtcctcggccagcagggcgtccagggcttcctgcgcctccggggcggcggccggggcgaccgcggcctcccggtccagcggcacgtgggccgacagcccgtaccgccgtccgcccgccgtgagcccggacgcgggaccgagggctcccgcctcgtcggcccgggtgagcagcccttcggtgtcgccggaggtcagcggcaccaggaaggagccgtagggggtgctcagttcgaccgggcgcccggaccgggtgcggcgcaggtgcgcgagcagccggcgcgtcaccccgtcccgggtcagcgcgtccagtcccagggcgcgggccggggcgtccgtccacggcagccgccgggcgaccatggccgcgctgaacacggcgttctccagggcccaggccgtcgcgggacgtcgcgccgccgtggccgggctgtcggcagtggtcatcggtcggtctccctcgtggtcacttgtcgcggagcatgtacggctggttgccgacgacttcaccgtcgtaggcgctgatcagcttgttgacctgctcccggtagtgcgtcagctccccgcgcagggtgtcggagtacgcctgcggggcgtgcgacagcgggtagtcgtacgactcgtccagccaggccagttcgacccagctctcgggcaggtcgtggggcgaggccggtccgcggccgtccagcatcgcgatcacgtcgtgcttgttgacgaggctgatcacctgcgtggtgtggtcggcgggccgcttgccgtcgatcggggaaccgagcgtgatcacgtgggtgacccggtacgtggacgacacctccacgtcggtcgcgaggttcatcgcggtgagcccgcccaggctgtgcccgacgatcatgagttccgaccccggcgggaccgcggcgcgcagcagcagcttcttcgcggcgcgcgtgtacgtcgtgtccgtgcgcagcaggccgtcgaaggcgccgaccacgtcctgcggggtgctgttgctcagcagcccgaagctggtccccggcagcagcaggacgtgccggacggcgccgtcggcgcaggcgacgcggcgcagcagcaccaggccgtggttgcccagggccccgatgtcgttcacgtagctgacgatgtcgttgtgcgaggtggcgaggaccttggacaggatcgggtccggctcggcgcgctcggcgcggcccgggccggggttgaggaaccgcagcacggaactcggcagtccgaggaaggggtcggtggtcggcaccccgcccgcgagcgtcacccaggagaagtcgtcgttgaccgggttctcgtcgagcatcccgagcagggccagcagctccatgatcaccgggctgatcgtggtcagggcgcgggtcacgcccagcagttcgatcagcgctcccatggcccgcagcgcctccaggcgcctgcccgccaccaccgcgtcggtgacgcgccgggcggacggcgcgtccaggtgggggtgctcggcggcggcggccttgatgcgcagcgcgaaggcgtccacggccatggccaccttggcggggcgcaggtaggccatgttcccggccatccgggccagttcgccgacgaggccgccgttggcgccgaacccgagccccgacgggcgggtgagggcctgggcgcaggccaccgccgtgccgagcgcccagccggggcggcgcatcgcctccaggccgaagcgccagctgaacagggctcccgtgagctcggcccccgactgcctggccgtcagggccgcgtccgcgagcaggaccgacgcggcgatgaggagctcggcgtcggtccgctcggccggcgcggtccgcccactcggctcggtccgctcactcgccggggcggccgcggagcccggggagaccgcggagtccggggagaccgcgtgggccggccccggctcttcgccgacggtgtccggcccttcccgtgcggggagctgcccgtccgttttctcgaccacccgaggcgccactttccgtacctctcgtccctgcgcaccggcctcgcggccgagcccgcccgtacccgctgtgtgcgctggcatggtggcaccgaatgtgatcgtttccgtgcgctccggggcccgtccgagggcggtggactcctcgtggagcagcgccgatgggcggcgggacgcccgcgcggcccggatccacggggcacggccggtccgcgcgcggccgcttcacccggcgggatccgacccgccccgcagggatgatcacgggcacccggtgttgacccgggctccgcgggggccgtcggccggctcagggtgtggacgtccagccctgcccgtggagccgttcgaatccgtccaggagcaggtccagcgcgaactcgaactcgaactggtcgtcgcacccctggccgacgaccgaccgccggtcgtgcgccaccgcccgggccagttcggtgacatggggatagcgtccggccatcgcctcgtgcgcggccgcctgctcccgctcgtcctgcggcgcgctccccgccggggcgtcgaacagctcctccgtgaagcccagcacccggctgccgagggcgtgcatcacgtggtgggtgaggtcggtcgagaagccgccggcccggaacgttccgatcaccgagtcgagatacgcgagcacggcaggcgtcgggctggtgcgcgacctgatcaccggagcggcccaggcgtgcgtgagcagggcgcggcgcgcgccgaggatccgcgcgcggaccgcgctcctccagtcggctccggggacctggcgctcgatgcccgcgacgacgacttcgaccatgccgtccaggagctcttccttgttggccacgtgcttgtagagcgccatcggtacgacgcccagttcctgggcgagtccgcgcatgctcagcgcctcgatcccggcgccgtcggcgaaggccacggcggcgcgcagcacccggtcccggctcagggggggccggcgtcgttcctgcggctgctcgggcatgtgggcctctccctcgatgtgttcggttcccggggcgggcgggggcggcactcctcccgccttgacgagtgtacggcgtacacctagggtgagcgccaaccatcaggtgtacgccgtacacccgtaagggaggggttgttccgtatgagctcgaccaggagaaccgcgatcgtcgccggggtgctgttcctcgtcacggagatcgccgcgatgggcgggctcgcgctctaccgacccgtcctgcacgacaccggctacgtcctcggaccgggggccgacacccaggtgttcctgggggcgctgtgcgagttggtgctcgcactggcggtcacgggcacgggggccgcgctgtacccggtgctgcggaggcggaacgagggcgccgccgtcgcctacgtctgcgggcgtctgctggaggccgccgtcatcgtcatcggcatcgtctgcgtgctgtcggtcgtgacgctgaggaggcgggccgagggcgggacgagcaccgacggggcttccctggtcacggccggccaggccctggtggcgttccacgactggacgttcctgttcgggccgaacttcgtcctcggggccaacaccctggtcctggcgggcctgatgtacacctcgcggctcgtaccgcgttccctgtccgtcctggggctggtcggcggggcgatgatctgcgcctcggcgaccgccgtgctgttcgggacctacgagcaggtctcggtggcggggtcgctcgcggcgctccccgtattcgcctgggaggtgacgctggccgtccggctgctcggcaagggcttcgacgcgggcacggacgacaccgccggtgccggtgcccgtgccggtgccggtgccggtctcggtgccggtgtcctgtgacggcccgcgccggccgccctcaggacatccggtccacgttccacatcggcaggccccggaagaagtccacggcctccgcgcgccagtacggctgccaggacgcggcctcggcggcggccgcctccgcgtgccgccggatctccgccctgagccgccggtccacgccggcgctgcgggcgatctccctgatccggcccagggtctcgtccgagcagccgggatcgccgagcgccgcttcgaccaggcgcgcgtccgacccgctcgcggcggccaggaccgcgcggacggcgtaggtgcggcggcccgagcggatgtcggcgccggtggacttcatctcggccgccgggccgtcgccgtacgggccgaacaggtcgaggaagtcgtcgcgcatctgctcggacacgcccaccagccgtgcgtagcggtgcagccgggcgcggtgcggccccgggtcctcgcccgcggccagcaggcccatcgtcagcggtgcgaggatcgagtaccgcgcgctcttgaagtcggtgacggtgtgcaggagttcctcgtcggggagggggtgggagtcccgctccaggtccgcgatctgcccggcgacggtctccgccgcgatgcgcgtgtgcacgccgagcagcgcctggcggagctcggcgggagcatcggcctccagcagcacctgggtggacaggaaggcggcgaggtcgcccgcgagtatcgagagcccgagcgccgttgcgtcctggcccgggaactcccggaggtaggcgtagtacgtcgaggggccgccgcggcgcaggggcgcgtcgtcgatgatgtcgtcgtggacgagcccgtgcgtctggagcagctcgatgctcagcgccgcctccgcgagccccggcacctcgtcggtggtgaccagccgggccgcctcgtacagcaggacgacccgcagccgcttgccgccgcgcatcgagaactcacgcaggagttcgaggcagcgggggacgtaccggctgggcaccgggacgtcgaaccgctcgccgatgccgtcgaagtactgctcgaaccgggcgtcgaaacggatccggtgaccggcgacgcgttccagggtggtggcggtgacgttggcatgcatgaagatcagtatcggcgagccccgcgtgacggtacatcgcccggcggcccggcggcccggcggcccggcggcccggcgcaggtcgggcggcccggcccggcccggccacggcgcggagccgttcatccccccgcgggtgcggcggagaggcagtcccgcagttcggcttcgccggcgttcccgcccgtgcacacgatcgccacccgctgtcccgcgaggtcgtcacgcgccgcgaggagcgcggccagcggtgcggccgcggccgcctcggccaccgttcgggcatcgcgcatgagcagccactgggcccaccggatgtccacgtcgtcgaccagccggaagtcggcgaggtgctcccggaacagacgctgcgtcagctcgaagcccgatccggtggccagtccctcggccgcggtggtgttcggacgctcgacacagcggcccgcgcgccaggagtcgtgcgcggcgggggacaggcgggactgcaccgcgatcacgcggcagcccggactgatcgccgcggccaccaggccggcggcggcggcgccgctgccgccgccgacgggcacgacgaccgcgtcgaggtccggctcctgctcgaagacctccagatacgcggtggccacgcccgcgatcagcgccggctcgttcgccgcactgaccaggcgcatcccgcgccggggcgcgagctgctcggcgtggcggcgggccgcttcgaagttcgcgccggattggaccagttcggcgccgagacgccgcacggccgcggccttgagagggttcgcgttctccggcatgacgatggtgcacgggacgcggaagagcgccgcggcgtaggcgagggactgcgcgtggttgccggtggagtacgagaggacaccccgtgcccgctcgtccggatccatcgaggccagcagggtgacacccccgcggaccttgagggcgccggtcggctgcaggttctcgtgtttgaccagcacccggatgccggcgccgacggtggcgtcgagggccggataggagagcaggggggtcggggacaggtgcgcgctctgcagacggcgcgcgcgaaggacgtcggagatcgtgggaaggtgcatgccctcatgctgcgcaggggccgatccataggacaaatgccggattctgatgaacccatcgatatcatcgatgaatgttcgacgagaaccgactccgtgtgttcgccgccatcgcccgcgagggttcggtgacggccgccgccaccgcactgcactacgcgcagccgtcggtcagtcatcacctcgccaggctcgaggccgaggccggcgtaccgctcgtccagcgggcgggccggggcatccggctgaccgaggccggccgcctgctggccgatcgcgcggaggagatcctcggccgtatcgattcggcccggaccgaactggccgcccatgcggggctcggcgccgggcgggtgcgcctcgcggcgttcccctccgcgctggccacgctcgtaccgacggtgagcgccgccttcggcgtccggcatcccgacatcgaactggccctgaccgaggcggaaccgccggaagccctggcggccctgcggcgcggcgaggtcgatgtcgccttcaccttccaccacggtgacggcccgcccggtggccgcccgggccacacggcgacctcgatcctgcacgagccggtgtacgtcgtcagccgggacggcgcgtcctggccgggtccgcgcgccgacctcggcacctatcgcggacaacggtggatcgccggttgcgagcggtgccgcacgcacctcctgtcggcgtgcgagaagcgtggcttcactcccgcgatcggcttcgagaccgacgactacgtcgcggcccaggcgctcgtggccgccggtctcggtgtcaccacgctgcccggcctcgccctgcgcgctcaccgccaccccggtgtgcggatcgaccgcctaccggacgaacaccgcttcgtcgacgccgtcgtctacggcgcaccaccggtccccgccccggtcgaagccttcctgaaggtgctcggggaaaccgttgtccagcccgtcgagtggccctgaacctcagccggcggaggcgaagacgcgcaggccggtcaccgaccacacctcccggatgcgcccgtcggtcacggccagcacgtcgatgccgctcttggccaccggggtccccgaggcgtccgggaacgtcacggtccaccggcacgtgatccggccggtcgcctcgtccacgaccggctcgccgtcgaggcggtagtgcaggccggggatcgacgcgcggtggtcggcgacgaagcgggccaggtcccgcggaccgcgcaggtcgtcggtggcggcggactcgacggcgttggccagggagatccggaagcccggggtgacgatccgcgcggcgaggtccgtctcaccgttccagagcgccgtccactgctcgaacagggtggaggccagggaccggaagccggtggtgcgggcggcgttcgtcgcgatgtcggtggtcatgggaagtcctcgattccgttgcggtgcttctgctgtcaccaagactcccggcctcccgcgacaccgtcctgtcggtgtttacggtcacactcggtccgcccggtccgcgccgcccaacccggccagccctgtcagctccctcccgagcacgtccagttgggcgatgtccacctcgcggcgcggcgcccgctccggcagtgaccgggcctccagcacccggtcgaagcggaagccgcgcggtgcgtcgcggagccggcaccacgcgatcaggtaccagtgctcgccgcccaggaagcccaggggctcgaccagccggtcggtggcggcgccgtggcggtccgcgtaccgcagccggaccacgaggccgtcggtcagggcgtcctgaagcacccgcggcaccgcgggcggacccggcgtcccggtgtcgaccagctggacctgcgaggcgaaggcggcggcgcggtcgcgttccgggggcggcatgacggcgagcaccttgtgcagcgcggagcgggcggcctcggtgaagggggtaccggccagcgcgtgcaggccggcggccagtgctgtcgcctccgcggcggtgatggccagcggcggcaggctgcggctgcggtccagtacgtagccgccggtccggcccggttcggcgtagaccggcaccccgccgtcctgcagggcccggaggtcccgttcgatcgtacgggcgctgacctcgaagcgtccggcgagccaccgggcgctgcgcggccggggcgccaccgcccgaagctcctcgaccagtgcgtagagtctgtcggttcggttcacggggtcccagagtaggccgcccgcccgcgccggcggtctcaggggccgcgccggcgtatggcgagggcggcgatgtcgtcgtccaggctgcctttgctgtggcggagcaggtcgcggtgaagggccgcgagcagttcgcggggcggtgtcgggggctgccggcccatccaggccgccagcgggaagaactcgccgtcgcgggcgcgggcttcggcgatcccgtcggtgtagaggagcagcaggtcgtcggaggcgaagtcgaaggtgtcgacgctgtagtggtcgccgatcagctcggcgaggctgagcagcggtgagggggtgacggactcaaggatgtgcagttccccgcggttcaggagcagtggcggggggtgtccgcagttgaggatgtcgatgcgtctgccctcgtgcgggatctggacgagcagggcggtggcgaaacgttccatcggcccctcgggtgggaacgcggcgttgtaacgggtgctgctggcatccatccggcgggcgacctcgaccatgtcggtctcgtcgtaggcggcctcccggaaggcgttgacgatcgccgcggcggcccccaccgccgggagccctttgccccgtacgtcaccgatgagcagcctgaccccgtacggggtgtcgaccacctcgtagaagtccccgccgatgcgggcctcggccgcggccgcgaggtacagcgactcgatctcgatcgcgccgaagcggcggggcatggggctgaggaccacttgctgcgccgcgtcggcgacgagccgtacctggaagagggtgcgctcgcgctggagccggagatggcttccgtacgcggcggccacggtgaccgcgatgatccccgcggccgtccaccacgttcccaggtcggggaagacgaagccgaggccgatcatcaggcagaggcagaccgttccgagcaggacggtcggaagcaccggccacatggcagcggccagggccggggccgcgggcaggaggcggctgaaggccatctccggcggagtggcgtacgccaggctggcgatgaccacggtcaggaagaccggcgacagccgcacaagtcgtcccgggccggggcgccggcgtacccgcggccgtccagactcgatcacacttcacagggtatccacgtaatgcgggcacagcgctctggcggccgccgcccgccgcccgcaccgttccttcccgatcgcccggccgccggccgtcgtgccgggctccgcaccggggactaccaggcaaaacccggggcatcaagccaggcaggacgcactgcggcccgggggatcccggagcgctccgctctttcgccgcgcacgcgtaccggccggtttgcggaccgtttctgtccgcttcggtccgcaggatttccatcgaacacatgtccgctgtgcgaacgggcgctccggcgtgacgccgggtacgcgccggagcgggggcgcgcgacccgcgtgacgggccagcccgcttccggcggcgcccggatgccgctccgtgttgctccagtgggctgacgtggggcttgtgaagtgccacgatgatccgtgcttcaacagtgtgccggacgggacgcggtgagagcggtgaccgcgggccccggaggcggccctaccccacgaaagggcggacaccccatgcgcgtcacccccctcgcaccatccttaggcagcggccagggatcggccgcggacgatcccatacgtctgtactacagccgcaagacgcaggagatcctgcacaagtacggcccgggcccgcgcgtccacttccacgtgggcctgtacccggacggcccaccggacaccaccgtcccccagagcgtgctgaagcagcgcatgatcgacgcgcaggaacggatcgtccagcactcggcccggtcctggggcgcgtacgaggcccctcccaggcggctgctggacatcggctgcggcctcggcgggacgtccctgtactgggcgcaggagcatggggcgtcggtcaccagcctcaccgtcgccgcggaacacattccgatcgtccggcacttcgccctgcacgccggggtcggggagcgcgtgaaccccgtactggcggatgtgcacgacctggacgaaacgcgtgcctacgacgccgtctacgccaacgagagcagcggctacaccgaccggaccagactcttcgaagtcgtcgccaaggcgctcgtgcccggtggatggttcgggatccaggagcatttcgcgggccgctccgcgtcgcgcgagttcatcgacggctactacagaacgcggctcggactgagaggggagtacctcgccgcggccgaggccgccggattcgagctcgtgcacgacgaggacgtgacggactcggtgacggagttctgggtgcagtccatggcgtggaacaccgccgaactcgaccggctccgcgcgggcgccgacgccgagcccggcgcctggtccggggaacggctcgaacagtcgacgctggcgcacggcaggttcttccggctctggcgtgaccacgcggtccagacgcggctgctgcgcttccggctcggtggccgcccgtgacggcgccaccggcgccgccggcgccgcgcccctcgctcctcggtccgcgcctgccgtccttctactgcccgctggagcgcgacctcgtccatcccgaggcgaagcaggtggaggaccgggcggtcgcatggctggacgccttcggcgtctacccggacccggtcgagcgcgcgtggggtctcgccacccacagcgccgacttctcctgccgcatcatccccgacggggacgtggcggccgtccagctcttcaccgagtggaactactgggccaacgccgtcgacgactggcaggattcgggctccgacgaggtggggacgagtgccgtcgtcgaacacggcgtacgcctgctgcggaccatcgaggacccgggggcgtcggtactgcccgacggacccatgacccgcgcgctgctggacctggtacgccgcacccacgccatgctcacgccctacgagctgcgcaggttcaccgaggggacgcgcgactggctgctcggagcggcctggcgggccgcccgggccgaggccgggaccatgcccgggctgaacgacttcgtcgccatggggccgctggccaacggcacgcgcttctcgctgacctggtccgacgtcgcacgcggggaccggctgccggcggaggtgctctgttcccgcgcgctgacggcactcacggacacggcgggattcgtcgtcagcgcggacaacgacctgttctcctacgacaaggacgaccacctgcggccgcgggagatcaacctcgtcaacgtcctcgcccaccaggagaactgctcgcccgccgaggccgtgccgctcgcggtggccctgcgcgaccgggtgatggtccgcttcatgacgctgcgggcggggctggaggaaggagcgggcgcggaactgcgccgccatctggcggcgttggggcactacgtggccggctccatcacctggcagagccgggcgccgcggtacgcgagcccgcgtaaccggcacgaactgcccctcgcggacgccgggttcgaggtccggttcgccgacgcccccagcttccgcggcaccggggcgccggacctgccggccctcgcctcctggtggcgggtacccggctgagcgatgcccagggctccggccggtacggcgggagccctgggccggaagccctgggccgggaggccgtcagacgcggccgagcagcctcttccaccagctgacgccgcgaccgcgaccgcggcgacggcgaccggcgacggcgggcgccgccgtcggctgcggcgggatcaccgcgtgcacggggtgcccggccggctgttcctcctggggcagcgggtccggcgcggcgcgcggggcgaaccgtaccggcagggacagcaggtggcgtgacatgagggtgccgcgccattgcagctcgctcgcgtcgaccgccagctggaggtcgggcagccggtccagcaggacctcgatgccggtgtccgcgatggcacggccgatgtcctggcccgggcactcgtgcgggccgctgctgaaggccaggtgggaacggttgccgtggacggaggcagcgggatcgggccggatctgcgggtcggcgttgcccgcggccagcccgagcaggatcatgtcgcctgccttcacctgctggccgccgagctgggtgtcacccgtggcccagcgcccgatgatcgtgttgatcggcggatcgtcccacaggacctgctccagggcgtcgggcagcgtcatgtggcctccggagaggctggcccggaaccgcgggtcggtcagtacggtccgcagcgtgttggcgatcaggttggcggtggtctcgtaggccgcgatcagcacgacgcgcaggtgcatcagcacctcggtgtcggtcaggtcggcggggtgctcgatcagccaggaggcgaggtcgcgggccggcttggccttgcgctcgacgaccaggctctccagcgtggcggtgacgtagcggtcgctctgcagggccgtctcggttccctggagcatgtcgcgagccgcgttcaccagaaggggcccgtgctcgtcgggcgccccgatgagctgcgtcatgaccagcatggggagctggtcggagaaggcggacaccaggtcggcgtacccctcacgcgcgatctggtcgacgagctggttggcgaagcgggtcacgtagcggcggatgccgcgcttgtcgaaccgctccagggactccaccacggccgagcggagccgctcgtgagcgggtccgtcggtgaagttgcacaccggcacccacgacaccatggggccgagcggggtgtcggccggcacccggccctcccgcatgtcgcgccatccccgcgggtcgcgggcgaagcgcgaggacgtacgcgccacgtccaggttctcccggtggccgaggaccagccaggccgggaggtctccgctcaccagtacgggggccaccgggccgtgctcggcccgcagcttctcgtacagggcgaggggatcggcctgggcctccgccccgtggagacggtgcaggccacccgtggtcgccgccgcgtgggcggggcactcgggcggtggggtggagccggtaccgggggtgggggtgggggtggtactcacattgcctcctgggtggctgcctgggagtgcaggtagcgcatgagggtcagcaggacgtcgcgggacgattcccgccgcctggcgtcgcaggtgaggatcgggacggaggggggcaggtcgagggcctggcgcagttcctccagcggatgctcgggcgcgccggggaaggagttgacggccacgacgaaggggacgccccgctcctcgagccgtccgatcacatcgaaactgatctccaggcggcgggtgtcgaggagcacgaccgccccgagcgctccctcgaagagcccgcgccacaggaaccagaaacgctcctggccaggtgttccgaacaggtacaggacgagctcgtcgttgatgctgatgcggccgaagtccatggcgacggtggtggtgatcttccggtccacgccccaggtgtcgtcgacgccgacgccggcccgggtcatcgtctcctcggtcgtcagcggcttgatctcgctgaccgcaccgaccatcgtcgtcttgcccaccccgaatccgccgacgatgacgatcttcacggcggccgcggccgtctgcgggagtatgtccgccgggcggggccccgtgggcgggtcagagcttctgaagtccatcgatcactgcctcgatcagagcaaggtcgggtagctgcgcggcgggaacgggcggacggacgtacacgcgtcgagcggccatcaggtccccgaccagcacggtgacgacgctcacgggcaggcccgcgtatgcggcgatctcggccaccgacagcggtgactgacacatccgcaggatggccgcctgctcgggctgcatctcgggccgggcggaccctttggccacgactaaggtcacgaggtccagatggacggcggtggagggtccactgcgtccgccggtgatgacgtagagccgttccgggctgctgtcctcccagctggtgggcggctcattcacgcgggctgcccgtcatgccggggcgggctgctcaggtggtcccccattcgggtcaccaggttgcgcatctgcgcgcccatcaggcccgcgtccacgccctcgtcggcgaggaccgcgaggtaggagccgtcgccggcggccatcaggtagaagaacccgccgtccatctcgatcacgaccaggcgcatcctgccctccgagcggggcagctccgccgccaccgccccggccaggctctgcaggcccgcacaggccgccgccaggcggtcggccgtgtcggtctcggccccgtactgcgccacgcagagcccgtccgcggacaggacgatcacgtgccgcgtctgcggcactccggcggccaggtccttgagcatccagtccatgctgctgattcgctgagtcatcactgttcatacccccttggtcgctgatcccgacgcgccttcggcgcccggcacgtcgtggccgggcgtaccggacagtccgctgtggaacgcctccagccacattccggggccgccgtcgtccgccgactgcggctccacggccggccgggggtcggagacggccacacggtccttgcggcgtcgctgcggcaggccggtcgcggtacgcgcggtggccgccggctgctcgacaccgacgggcgccggcctgggcgccggagccggccggggcacgcccacgcccgccggcgagcggtcgaaggggtgctcgcgcggtgtggcggccacggccctgggccccgaggaggagccgatgccgtgggcgagaccggtcgcggaggacgccgtcgtgatcaggtgctgcggcacgatgaccacggcacggacgccgccgtacgcggacgagcgcagggacacctggaacccgtacgcctgcgccagtcggccgaccaccgccagccccagcctcggcgtctcgcccaggtcgttgaggtcgatcccggactgcgcctgggcgagcatcttctccgcccgcccgcgggcctcctcgctcatgctgaggccgccgtcctcgatctccacggcgatgcccgactgcacctcgacggccgtcaggtggacccgggtgtgcggcggcgagtaccgggtggcgttgtccagcagctccgccagcgtgtggatcagcggttcgacgatcggaccgacgacggcgacctcggagaccgagtggagctccacccgctggtagtcgatgatcctcgacatcgctccgcgcatcaccgagtacagggtgacggccctgctccactggcggccggggcgcgcaccgccgaggaccgagatggagtcggcgagccggccgatcagggcggtgccgtggtcgagccgcagcaggtcgccgaagacgtccgggttggtgccgtgccggtcctccatctcgcgcatctcgtgggcctgctgatggacgatcgcctgcacccggcgggccacgttcacgaaggcccgctgcgccgagtcgcgaaggctctcctcgttgtcgaccgcgtcgatgacgtgggacagcacggcctgcagggcggcccggaagcgcggggtcagggcctcgtcgtcgccccagcggttgccgtggccgccgcgcccgcccagggcggtcagcacgtcctcggccagctcgcccttgcgcagccgctcgatggcctcgggcagcaccacctgggacagccggcccgcctcggcctcctgccgggccaggacgtgctggagagccgcgacctgggcgcgcccggcggcggccgtgcgaccgcgccgtaacgcctcgaccaggatcgcggcggcgcacagggcgccgacggagatcaggacggtgccgagcggtcgagaggaggagacgagcgcagctgccaggcaggccgcgcccacgaccgcgaccgcgggaagcaaccggctcgctcttccctcaaggtggggactttcggggggagtacctctttgctgcatcggcgtcctcgaactatcgaaaagggggaccttctgaccggtggccgggagcataacgacgcccaacttcccgcatgcgggctttcgttggagttcatcggaccggaggatcggtaatgcgccatcgaaggtgccgaattccggcgagggaagagccccttatggggtgtgtgatggcgtcatggcaggtccacggcttgtgggcgccgcgcgaagcgcgggaactccgcgctcgcctttcgatcgatttcggccgcacccctgtgttcggcagtggcgccgtggagggaaatgcgctaaggagcgtcaggtcgcgcggtctcggcggccgctgcggaaccggccggcccgaggccggtgagcaggacgtcgagggcgaggtcggtcgcctcctccagcggagtgtcgtcgaggagtgaacccacggccagggccgcgaggccgtgcaccacggagaaggcgacctgggcgagacgggccgggtcgccggcccgtatgacaccctcccgctgcgccagggcgatcagttcggcggcgatctccaggctccggtggccgagctcgcgcagttcgtcgctggagcggtcggcgtgcttggccgtgaacatcaggctcagcaggggggcgtgcgcgacggcgaaaccgacgtaggcgcggcccatggaggcgagccgggtggcgatggggccgggctcgcccacggcggcccggaggcgttcgttgagccgggtgaagccgcccactgcgagtgcgtcgagcagcgcctgccggtcgcggaagtggcggcccggcgccgcatggctgacgccgaggtcccgggcgagggcgcgcagcgacaggctgtccgcccccgaggtcgcgagcacctcttccgcgcgggccagcagggcctccctgagattgccgtggtgatagggcgcgtcggcgtcggccaaggcggtctcctccctcgatgttgtcattgacaacaatgtttgctctgtctacatttaagtatcgaccaacagccggagtcccggaacggagcgccgacccatgtctatgacataccgcggaaccacagccctgatcaccggggcgagcgcaggcctcggcgtcgagttcgcccggcagtgggcgcagcgcggagcggacgtcgtcctcgtcgcccggcgcgtcgaccggctggaggacctggcggcggacctggagcgccgctacggggtcaaggcccgcccgatcgccgcggacctcgcccggcccggtgccgcggcggcgctgcgcgcggagctcgacggactcggcgtaccggtccacacgctggtcaacaacgcgggcttcggcagccacggccccttcgccggcgaggaccccacccggatcagcgagatgatccagctcaacgtgctcgcggtcacggaactgaccagggagttcctgcccgccctgacggccgacggccggggcgccctcgtcaccgtggccagcgcggccgcctaccagccgaccccggcgatggcggtctacggcgccacgaaggccttcgtcctgaacttcaccgaggccgtcgcgtacgagacgcgcgcctcctccctgcgggtgctcgccgtctcgccgggcccggtccgcaccgagttcttcgacgtcgtcggcagccgggacgccgccgtgggccgcatggccaccccggagcaggtcgtcaccgccacgcgccgggcactggaacgcggcaagaccccgcccagcatcgtggtcggtctcggcaaccggctctccgccacggcgtccgccctggcgccccgccgcctcgcgctgaccgtggccgggcgcgccctcaaggcgtgaccgggcgcgcctgcgcgccgaagggcgggccgtcgcaggggtgacggcccgcccttcggtactgcggtcctgctggcacggccaaacggatccggaggctcccccgtgggtctccggatccgttcgccggtgggcgacggtgggaccggcctaccaggcggcgcggcagttcagcagcttggcggtgccgaccttgcggtcgcaggcgtaggccttgacgtccttcttgtccttgaaggtccagctcttcgagccgttgaccacggccacgtggttcttcacgctgtgccaggcaccgcccttccagtcctggtaggacagggccaggaccgcctcgtagccgtcgcccgccaccttgtccttggccgtcgcgcccttgaacgacccggcgtagagcttctccttggtctgcgggatcgttcccgaaacgtggtactcgtaggtaccgctgatctcggccttgccgctggtggaggtctggttgaagccgatggtggccgcgctcgcggtgcccgccagcccgatgacgagggccgaggcgactgcggaggctccgacgagcatgcgcttcacaggagtggtcatggcgatgtcttcctttcccggaaaatcggaacgtggggtgtgcgccgccaccacacggtgctccggcggtcggccggacagaaaactaggcgagccggaggcagtccggcggcacgcaccgggttgattcggggctccacccggtgccggtggcggccggtcggcctgcgacttccgcggtacggggaccatgcggccgcggtaggaaccggtcctgcggcaggcgcatggcccggccgcccgaaggcccgtaggctgcgccgatgcacgctggatcgggagttctcgacaggctcgggggaaggtaccggccgctgctcgtcgacctgttgctcgccctgggctacgtcggcgccgggctgttgctggggcgggagcagccgccggccggatggcggcccgtggacgggccgggggcggtcctgaccgccctggtgggtctggtcatggtggcccggcggatcgcgcccgtcgccgtgttcggcgccgccgccgtgctgtggatcctcttcatcgcctgcgggtactggccggtggtcaattcgatgcccgcgctcctggggctgtacacggtggcggcgacccgtcgcccccggacagcgctcgtgtgcgcggccgtcgtggcgggagtctgggtgtacgccggggtcggcaacctcgacaacagctccatgccgaccgtcctcgcccaggcggtcctgttcccggccgtcgtcttcgtcgtcggtcgcggctcggcggccctcgccgaacggaacaggcagttcgccgaactgaccctccagctgcgccggcagcaggaggagcgcgcgctccgggcgctcacggaggagcgggtgcgcatcgcgcgggagctgcacgacgtggtcgcccaccacatgtcggtgatctcgctccaggcgggcatggcttcgtacgtgttcactacggacccggcggcgagccggcaggctctggacaccatcgcggacaccagccgggaggcgctggaggagatgcgccggatgctcgtactcctgcgggtcggccaggagggaccgccggaggacggcaccgcctacgcgcccgcccccgggctcgacctcctggacaggctgctggagcgggtgcgcggagcgggggtcgaggtcaccatggaggtcgcgggatcccccacccggcttccgcagggcatggccctgtgcgtctaccgagtggtccaggaggccctgacgaatgtgctcaagcacgcgggaccgaccagggcggccgtcaccatccgctacgaacgccgcaccgtcgtggtgtgcgtgacggacgagggggacggcaacttccggccaaaccaagggatgtcacctggtcacggcttgatcggtatgagggagcgcgcgaagatctacggcgggtcggtcaccgccggcccccgcgccctcggcgggttcgaggtacggctcacccttccggcgcccaccctcagcgaccggcggggtggtctcccggccccgggcaccggggacgtccccttccggtgaggaccgaatcgcccgatgcccacggtactggtggtcgacgatcaactgctcatccgtgccggactggtgtccctgctgaacgccgcgccggggctgtccgtggccggggaggcgtgcgacggggaggaagccgtccgcctggccgaggccaccacacccgatgtcgtcctcatggacctgcggatgccgggcaccgacggcatcacggcgacacgacgcatcctgcgccgggccgccgacacgggtgacgcagcgcccaggatcctggtgctgaccaccttcgacctggacgagtacgtctacaacgccctgcgcgcgggcgcctgcggattcctgctcaaggagacgcccccggaacgtctcgtcgccgccgtccacaccgtcgcctcgggcgacatgctcttcgcgccgacggtcaccagacgcctgatcgaggcgtaccacccggggccgacaccgccgggagagatcgccccgcagtggcacaccgtgaccggacgggaacgcgacgtcctgcgtctcgtggccacgggtgcgacgaacaccgaagtcgcccggcagctcttcatcagcgaagccaccgtgaagacccacctcaaccgcgcgatgggcaagctcgggctctccagccgcgcccaggtcgtcgtcttcgcctacgagacggcgctcgtgacaccgggcggcccgacgagcctcccgtgccctcaccccgatgagggcgggcccggctgagcgtccggggagccacgcgcgcggcggcctccccacccccacaatggaggccggcgagcgggaggggaacgggcatggcggacgagcagcccccggtgcgggtggaacgggacgggcccgtgtacacggtgatcctgagcagaccaggagcacgcaacgccgtggacggtccgacggcagcgcaactgggcgccgctttccgggagttcgagcaggacgaccgtgctgccgtcgccgtgctctggggcgagggcggaaccttctgcgcgggcgccgacctcaaggccatcggcaccgagcgcggcaaccgggtgctcgcctccggcgacgggcccatggggccgacccggatgcggttgggcaagccggtgatcgcggccgtcgcggggcacgcggtggcgggcggcctggagctggcgctctggtgcgatctgcgggtcgcggaggaggacgccgtgttcggcgtgttctgccgccgctggggggtccccctgatcgacgggggtaccgtgcggctgccccgcctgatcggcgagagccgcgccatggacctgatcctgacgggccgcccggtcaccgcggccgaagcgcacgcgatcgggctggccaaccgcgtcgtgcccacgggccggtcgaggccggccgcggaggaactggcccgcgagatcgccgggttcccccagacctgcctgcgccacgaccggctgtccgtcctggaacagcacggcctgaccgaggaggacgcgctggcgggggagttccggcacggcctggtaccgctgaacgcgggcgagacccaggagggagcggaccggttcgcttccggggcgggccggcacggcgccttcggacagtaggccgcggcccacgccgccgggagcccggggcgggcgtccgtacgccgccgacgtgtggcgcgtgccacggccggccccgggaacccggcctccggtggctgcgactcctgtcgtggaacggcccgtcggccgagcgatcgcgggtcagcggttcagtcgccgggtccagtcctcgggaacccggccggccgggcccggggccggctggtccgccgggtggtcgcgcggagcggtcagttcggggccggagtcgtacagggcgtccgtgtcgtagttccagaaccactcctcgcccggctcgaaactctgcacgagggggtggccggtggacttccagtgggcggtggcgtgctgggccggggaggagtcgcagcaaccgatgtggccgcactgggcgcagcgccgcaggtggaaccaccagccgcccagctcgtcgcactcgacgcagccggtgccggtgggcgcggcgcccgggtcgattccctcgatgtcgctcatgcgggctcctcggcggtcgcggtcctggtgtcggatccggtgtgggtttccgtgtcggcgtcgggggccggggcggtcagtggcagcagtacctggaagcgggtgtcaccggggaccgactcgacctggaggctgccgtggtgcttattgacgacgatccgccaggagatgtcgaggcccagaccggtgccctcgccgaccggcttggtggtgaagaaggggtcgaagatacggccgcggatgtccgccgggacaccgggcccggtgtcccggaactccaccagcaggcgatcgccctcccgcgccgtgcggaccgtcagcgtgccctcctcgccggtgctcccgatggcggacacggcgttgtcgatgaggttggtccacacctggttgagctccgccgggtaggcgggcacgtccggtacggagcggtcgtactccttgaccacccggatccgggagccgatcttgccggacagcatcagcagggtgctgtcgaggagttcgtggacgtcgacgacccggtacggggcgcggtcgagctgcgagtactgcttggcggcgtcgacgaggtgggagatgcgcgtggtggagtcgtcgatctcatccatcaacagctcggtctcgaccgtgtagttgagccagccgatggccgacggcaggatctcctcggccacggtcgccgcgacctgttccagccagtccgtgtccagtccggcctgtacgaaggtgggcgcgagccgccagccctccgcgatgccgtggtcgtccagccagtcggcgagttcgtcctcccggtcggaggcctccagcggactgagcgccgtggccttcgcgacccgttcgacggtgcgctcctggatgtcgatgagctcggcgatcgtctcgcgcgagtactggccctgggagatgtgggccagcttgtggcgcatcttgcccacccgttcccgcagcgtcgccgtggcgcgcacggcggccgccgccgggttgttgagctcgtgggtgaggccggcggacaaggagccgagcgccagcagccgttcgcgctgtccgatggcccgctgcgtgttcttggagccgaagaacagcccctccagcaggtgtgccgccatcgggaaccactcccgcatgatgtccgcgaacgactccgcgggcagtacgaagaaccgcgtgggctcggtcacccgcatcgagttggtgtacgtctgcggcacctgttcgcccaggtacgcctgcatggcccccgcgtacacgccgcgctgcgaggtgcggctgacctcgacgtcgtcgccgccgacccggcgggacaggacgacggtgccctcgatcatcacgtagaagcaggtggcggtggcgccctcggtgtagaccgggccggcttcgaaccgctccacccgcccctcggcgcacagccgcccgagctgctccggggagagcttctcgaacaggaacaacgaggcgatctcctgcgggctgcagggcatgacccgcccgctcacgactgctccaggtaccggtgtacgagcatcacggccatggctccctctccgacggcggacgcgacgcgcttcgcggactgggcgcgtgcgtcgcccgccacgaacacgccgggaatgttggtctccaggtggtagggcggccggtccagttcccactcggccggcggccgcccgtccggcgtgaggtcgggcccggtcaggatgaaaccgtgctcgtcgcgcagcaccgtgccgtcgagccagtcggtcagcggggccgcgccgatgaacacgaacatccactgcgcgtcgacgagttcgctcgctccgccgtccacgtcccggagcgtcagctgctccaggtgcccgtcgccgtgcgccgcctcgacgacggtccgggtgcgcacggtgatgttgggcatctcctcgatctgctggatcaggtagtacgacatcgacgccgccagggactccccgcgcaccagcagcgtcaccgacttggccccgcgcgccaggtacatcgccgcctgccccgccgagttggcgccgcccacgatgtacacgtcctggccctggcaggaggccgcctcggtgagcgaggagccgtagtacaccccgcagccggtcagctggtcgcagcccggcgcgcggagctgccggtacgacacaccggtcgccaggatgacgctgtgcgcggcgatcgccgagccgtccgagaagcggacgatgcgtgccgcaccgttcacctccagccccgtgacctcgcgcgccgtgaggatctcggctccgaaccggccggcctggcggcgggcacgctccgcgagctgggcacccgacacgccgtccgggaaaccgaggtagttctcgatgcgggagctctggcctgcctgtccgccggtcgccgaccgctcgaccagtacggtacgcagcccctcggaggccccgtacaccgccgagccgagccccgccgggccgccgccgatgacgacgaggtcgtagaaatcggcggccggcgtcgtcgccaggcccacgtgggcggccagttcgggcgcctccggttcgaccagcgcggtgccctcgggcgtgatcaccagcggcagccgccggccgtcggccccggccgcctccagcagccgccgtccctccggctcgtcggacgagtaccagcggtacggcacctggttgcgggccaggaactcccggacgtcggaggagcgcgccgaccagcggtggccgaccaccttggtggcgggtaccggccggtagtcgctggtgcgccaggccgtgagcagatcgtccacgaccgggtagagcttctcctccggagggtcccatggcttgagcaggtagtggtcgagatcgacgacgttgatcgcgtcgatcgccgcgttggtgtcggcgtacgccgtcagcagcacccgccgtgcgcccggatacaccgccagggcctgttcgaggaactcgatgccgttcatctgcggcatccggtagtcggcgaggaccaccgccaccaagtcgccgcgcagcttgagctcgcgcagcgcctccagcgcggactcgccggattcggcgcgcacgatccggtactcggccccgtagcgccgccgcaggtcacgggcgatggcccgggagacccccgggtcgtcgtccacggtcaggatgacggtccgcgctgtgtcggcggcctgtgccatacgtcgtctccaccccgagtgctctgggcaggcggcccggcgagccgcccgcgccggttcccgcccatcgtaggggcgatcctgcgggaccgctccgggacggcgtgctccgtgcgctcccggtacgcgcccggtcgctcctggtcaacgccctgcggccgtcggctcaggaacgggtgccggtgcccgtgcccgtgcccgtccccgccctgacccatccgtcgccgccgagggggaactcgtagccgggccgcccgttgtggccgctggtacggaagggcttgccgttgtggtcgatcctgagcgtgccgtgccgggatccgctggaccaggaaagctccaggtaccaggtcacgtcgtaggccgaggcgtcggccttgatgtggaacacctccggttcggactcggacaccttgtacgggaagcccggctggtccgcctccgggacgacggccgggcgcgcggcgtcgagggccacggtgaaggagcgcgtcgggacgccggcaccacagccgacccccggatagcccatggcgtagacgttccaggcggggggcgtccgcttgccgacggtacgcacggtcaggccgttcaggaccaccgtgtccttgcccgcgccctgcagggtgagcgtgacgtactgctcgccggcgggcacggcaccggccgccgccacccatgccggggcgtcgcgctccacgggcggcgggctgacctgggccggcggctttccgatgaggtactgctggtcgcagggcgactgccaggtgtggggctgggcgctcaccttcaccggcgcgccgggaccgctcccggccgcgggggcgacgggcggggagcccgagggctgcgcggcggacggctcggcggaggctgagggctcggcggacgcctccgcggaggacgcggcggacggctccgcggactccggcgcccggtcgtcggtacgcgcctcgccgggagcgaagggcgcggcgccgacggggccgccgtggacgtcgtccccggccggctgccggtccgtatcgagcacgagcgccccggcgagggcggcgacggcggccacggcgaccgcggccagggcggcccgggggaggcggcgccgtcgcgtcggcacggtcgcgtcggcggggccgggccggtcgggctcgtcgggcgagtcgggcgcagccggcgcgtcggcgggctgggacgggtccgccaggtcggcagggtccaccgcgtcggccgagacgggcgccgcgggcagcggagcggcgggctccggctcctccgcggccgccgcccgcgccacggcgtccgtaccggccgccttgcggccgcggttggtgtccgccagcacccaactccggtgcagctccacgagttccgcgggcgaggccttgcacagccgggcgagccgctcgaccggtgcgtagtccgccgggacgacctcaccgctgcagtaccggtgcagggtcgacgtactcatgtggagccgcttggcgagcgttccgtagctgtggccggagcggtccttcaactcccgcagcagtacggcgaacccggactcagccgtgtcctccggcactgttcctcccaccccgtgtcccgtcccgcatcccaggatcaggttgttcgcgcagctcagggcctgttccggcattccagcattcctgaacgccccgtggctgtggcggctgggacggatcaccggacaggctcaggccatccaagcacaccgctcccggcggccggttccgacccgaccgggccccgcgggcatgccctatgagaggccgtcagtcatgtacacgttccccagtgcccccagcgcgagcagcgtccgtacgccccgtccccgcaccttccggcggttggcgggtgcggccgccgctgctctcgccgcgctcgtcctcacggcgtgccaggacggtacgggcttcaaggacgggggagccgccgccaccccggacccggcctccgccccggcctcggcggctccgaccgctccggccactccggccactccggccgatccggcgactccggcggcttcggccgctccggtgacctcggccccgggctccgcgaagaactcggccgccccggcccggtcggccgaagggggacgggtcctgtgcaacggctccaacaccgccgtcaccgtccagccggtctcccgtccgctcaaccacatgctgatcacggtgaagaacaccggctcgaaaacctgtgacctgacctactacccgctgctccgcttcgacgagatgcagtgggcgccggccgcacgggaggagaccaagccccaggcggtggtgtccctcgcgcccggccggtcgggctacgcggcggccctgttgtccgcggccgacggcagcggtgagggcgggacgaccgggcaccggctcacgatcgccttccagggcccgacgcccaggagcgacggcggcgcgtccgccaccccgtccctcccggcggccggtgtgcactacgacagcgcgctgacggtcacgtactggcagcagaccggcgaagacgcgctcggttcatgacccgctcccgacgatacggccgtcacggagttccacgacccggtcggcgagttcgatcaggttcgggtcgtgcgtggcgacgaggacggtcaccgactcactgcgcaccaccgcgcgcagcagctccatgaccgaacggccggtctccgagtcgagctggcccgtcggctcgtccgcgatgatcaggtcggggtcgttggccagggcgcgggccaccgccacacgctgctgctggccgccggagagctcaccgggccgctgctcggcgtggtccgcgaggccgaccagggccagcagggtccgggcccgctcctcacgcaccttggcggggacacggcgcagccgcatcgggacgcccacgttctcggcggcggtcaggacgggtatcaggccgaaggactggaagacgaagccgatgcggtcgcggcgcagggcgagcaggcccggctcgtcgagggaggccagatcggtgccgtcgaggctgatccggccgccggtcggggtgtcgaggccgccgacgaggttcagcagggtggtcttgccggagcccgaccggcccctgagggcggtgagttcgccgcggcggacctcgaaggacacgccgcgcagggcgtggacggcctgcggtccgctgccgaagctgtggtgcacgtcgtcgacgaccacgatgggcgagccgtcaccctcccgacgttcccgcgtcgcgaccgtcgccggttcctggtgattgctcatcgcgtctgttcccccgtcgagttgtccgctggtccgatggtccgcctgccgggcgcggtgcccggccccgcgtcccgcacacgctgccgctgcagccttctgatcgcatttgcgcatccgtcgcaccaatcacgcaagccccttccctctctcgcccggatctgacagcatcgtccgctatccggtaccgagggtccggacgggggaggaattcaacacgtgctcggcttcgtcgtgcgccgactgcgcgggcgatggccgctcgccgtcgccgtgctgctcaccgtactgatcaccgcgaccactctgaccgcgctgacggcgttcacccgtggcgtgggcgaggaagggctccggcgggccctgaccggggcggaacagccccgcaccaccgtcgtgatcaccagtggccatcccgccgaatcccgggccaaggacgacgcgtccgtacgcgccttcgcggacacggtgttcgggcggctcccggtggcctccgagagcgtggcccgcagccggtcgtacggactgcccggcgtcgccgcctcgggccgtgacgccgacctgaccctgctcaccgcgctcggcaaggaccacgtacagctgctcgccggacagtggcccgggccggtcgccgcaccggccgcgcccgccggggcggccgggaccggcacctccgcgacgccgacccaggtggccgtgccgcgcgccgcgctcacccggctcggcctggccgagtccgcactgcccgcaccggtccggctggacgaccggttcggcggtccgccgctgaacgtgctggtcaccggcgtgtaccgggcagccgatccggacgccgcgtactggcggctcgacccgctcggcggccgcgaggtccacgccgacaccttcgccatatacggcccgctgctggtggacgacagcgccttcaccaccggcggcctcctgcagaaccaccgcctcacgctcctcaccccggacctgcgcaccgtccgcgccaccgaggccgaggccgtccggaccgcgaccgaccccgcgagcgtcgccctcgaacgcgccggctcgctgcgggccgccaccgaactgcccgcactgctggccgagctgaacgccggcacggtcgtcgcccgctccaccctgctgatgggcgcgctccagctcgccgtgctgtcgaccgccgcgctgctcctcgtctcccacatcctgaccgtccgccaggaaccggaacgggtcctgctcaccgcccgcggcgcctcccgccgccgcctcggcgcgctcaccgcgaccgagtccctgctgctcgccctgcccgcggccgtcctggcacccctgctcacaccacccctgctgcgcctgttcggccggttcggaccactcgggcgggtccacctggagatcccggacacctggctggtctggccggtcgcgggcggctgcgccctggcctgcgtcctgctgacgaccctgccctccgtcctgcgcggggcctcggccgccgtactgcgccgcgtgggcagccgccaggccctggtggcgggcgccgcccgctccggcgtcgacctggccgtcgtggtcctcgccgtgctcggctaccagcagctcgcgcagtacggcggtacggacgcccccgcggccggcgcctccgccggcgggctcggtgtcgacccggtcctggtcgccgcccccgccctcgccctgtgcggaggcacgctgctggtcctgcggctgctgccgttcgcggcgcgggccggaggacggctggcggcacgcggccggagcctggcccccgccctgttcggctggcagctcgcccgacggcccggccgggccaccgggcccgtgctgctgctcgtcctcgccgtcgccagcgggatcctcgccctcggccagcacagcgcgtggtccgcgtcccagcgcgaccaggccgacttcgcggccgcgggcggcctgcgcatctccgggagcagcatgtccccgatggggcagggcggacgctacgcggccctgcccggcggggaccgcctgataccggtggcccgccgcgagcagaagctgccggacgggaaccccgccgacatcgtcgcgctggacgccgtcaaggcgggcgaacgcgtgccgctccgcgcggacctgcgcggcgggcacggcatgcgggaactgttcaccccgctcgccaccggtgacgcgggcgccgcggccgcccccgtgagccccggtgtcaccctgcccggctccccgcggcggatcgacctcgacgtgtcggtccgggcctccgggacgagctgggccgccgtgagcctgctgctgcgcgaccggttcggggcggcctacgggacggcctcggtcaccctgcccgcaaccggcgacaccaccctgtccttccccctcgacgcgctgaccggcgcccccgtcggatcggcggccaccccgctgaccctggcggggatacgcctctcgtacgccggggacagcgacctccccggcgacggcagcgaactgaccgtgcaccgcgtcgcggcctccaacaccgcggacggcgccgcggcgcccgcccccgcggccaccggcggctggcagccgtcgcccccgcaggggtccggctcctcgcgcgtgccccagctgtccccggtccccgccggttccgcggacgtgctgcggctgcgctactggggcggcttcggcacccagcagggtgtcaacacggtcctgttcccggcgcccgccgcgccgccggccgccaccgtcccggcgatcgccaccacccgctacctgaaatccctgggcgcctccgtgggcgatacggtccccgtcacgctggacggcgcggccgtcccgatgcggatcaccgcctccgtggactccctccccgtggccggccgctcggcgctcgccgtcgacctgcacgtgctcggccggttcctgctggaatccgccggccggcagccggcctcacccaccgagtggtggctgcccgccgactcggccgccgacccggtcccggcccgcgcggccgcccaactgcgcgacggcgcccggatcgagcgcgtccagctgcgcgaggagatcaccgagcggctgctcgacgacccgctgagcgcgggcccgcagagcgcgctggccgcactcgccgccgcgtgcgcggtcctggcggccatcggcttcgcgacctccaccgccgccgaacggcgcgtgcgcggccgggagttctccgtcctgctcgccctcggcaccccgcgccgctcgctggcctgggcgtccgccgccgagggcggggtactgatcgtcatcgggacggcggtagggaccggtctgggggtcgccctcgtccatctgatggcgcccctggtcgtgctgacacccaccgccgggcggccgttcccacccgtacaggtggacatgccggtctggcagaccctgctgacggtcgccgccatcgccgccgttcccctgctgtcggccgcgctgagcggcccccggggccgcgacatcgccgcccggctgcgccccgtggaggagatgtgaccaccccgccgccgtccgccaccccgccgccgtccgcggctgccccgcgttccggtacgcggcccgcgccctgggtcaggacccggctgcgcgcggcacggctgggcaccgtactcggcgccgcgctggccttcgtggcggtcctgctggccgccgccctgccacgggcccaggaccggggcgccgaccaggccctgcggtccttcctggcgcgcagcggcgcggccggaaccagcctgcaggtgacggctcccgcaccggacaccgggcagaccaccggcgccctggacgggaccatggaccagctgctcgcccgtaccggctccaccttccacgtggaggcggactccgtggtccacggcacgcgcaccaccaagcgggagtcgctggagaacccggagctgtcccgcccgtccggcttcccgcccaggatggcgctgctgcacgtccgccaggccgaggcacacgtgaagatggtggagggccgctggccgggcagcacacccgtggccgccccggggggcgccgccggggaaccgccgcccctgcagatcgtcctctcgaaggccgccgccgagaccctcggcgcccgcgtcggatccgtcctgaagagcgcaccccgcgtcgacggcaccccctccgtggaggtcgtcggcctgtacacccccctggacgggaccgaggacttctgggcggacaacctggggtgcctcgcccgcgcctgcgagaactacatcggggagaacctcgcctgggacgtcgacggcctggtcggcaccggcgacctcgaccggatggccaactggagccgcaccgccgaggacttctggcggctcccggtggacgtcggccgcctgcgggcggaccggctcgacgccacgagccgggagatcgcctcctacatcgccggccccaccgccgccgccctcacccgggaaaccggccgcgcgcggctgcacaccacctcctggctgcccgagcagttcgaacaggcccgcgtccgcacccaggccgcggcaccgctcgccctgatcggacccgccggaatcggcggggtcgccttcgtcgtcctgtgcctggccggcgcgctcgccgccgaccgccgcgacgccgaactgcggctgctgctggcacggggcggctcccgcgccgccatcgtcggccgcctcgtcggcgagggcgccgtcaccgtgctcccggcggcagccgccgccaccgcactcgccgtactcctcctgcccacaccccggctcgcacccgcactgatcacggccgcggccgtcgccctgctggcgctgctggccttcccggtgagggccgccgtactgctgtccccggcccgcccgggcgggcggtggcgcaggcccgtggccgagctgctcgtcctcatcgccaccgccgccgccgtactggcggtccgccgccgcggggtcggcccggtcggcggtgacccggacccgctgctgatcgcggcaccgctgctgctcgccctgtgcggggggctgctgctggcccggctccagcccgtggtgaccggatggctcgcccgggcggccggccgccgttccgggctggtcggcttcctgggcctggcccgggccgcccgcggttcgggggccaccggaaccggaacgccgggccgcggccgcaccggcccctccgtcctgccgatggtcgccctgctcatcgccatcaccaccggaggattcggggccgccgtcctgcagtccgtggactcctcccggctgggcgtggcccggctcgccgtcgggggcgacgcggtgatctccgcgtacgggaagtccccgctcccgcagggactcgcgaaggccgcgggcgagctgcccggcgtgcggacctccgtaccgctgtggatcgaccacgactcctccgtagtcggcaccccggcaggatccacccaggtcaccgtggtcgccgccgatccgtccgcgtacgcggaactgtcccgtgtcctcggctgcggctccttcgacccggccctgctggccggcggcgacgggcagtccgcagacgccccggtacccgcgctgttcagcgcgggcctggcccggcaggccgccaagggcacgtacacggtgcggcccggcgacggcggagagctgcgggtacgcgtcgcgggcgtgctcgactgcactccggcccatccggcccgggacgccgcgaccgtcgtcctgcccacgggcgcggcgacggccctcatgggcggagccgaccatccgaaccggtggttcggcgtcggtgacgtggacggggaccggctgcgcgccctggtcaggtcgaagctcccggcggcgtcggcggcgtccaccccggcgcctgcgccggctccgatccctggttccggttccgtcgcgggccccgccccggtcgacgaggtgtaccccgtgcgcaccagcgccgatgccgtcgcccagctgggttccgatccgctgcagcggtcggcgcagcgcctcttctgggcctcggtggccggggcggccggcttcgcgctgctggccgtactgctgacgctgatgcgcaccgtccccgaacgcgcggcgctgctggcccggctgcgcaccatggggctgcgccgcaggcagggcgtggcgctgatcctcgccgagaccctgccgcagaccttggccgcgacgctcggcggggccctggtggcggccgccgcggtggccctgctgggcccggcgatcgacctgtccacgctggtcggcacccgcgtgccggacggagtgcggctcacggcgggacccgtactgacccaggccctgggcctcgccgccctggtcgccgcggcggtgttcgtggaggcggcgacatccgggcgacggcagatcaccaccgagttgagagcgggagaccagcgttgaacaccgaccagccgacgtacgaggagctgcgccgccgggcgacggccgccgcggagccgcgcaccccggcggcggacgccgcgatcgcctgcgaccgcctggtccggatcttcagccaggacggcatcgaggtacaggccctccaggggctggagctgacggtcgaccagggtgacctgatggccctggtcggcgcctccggcagcggcaagtccaccctcctgaacatcctggcgggcctggacgtccccacggccggcaaggcggccgtcgccggatacgacctgctggaactgtccgcgcgggaccggctgcgctaccggcgcgaggcggtcggcttcgtcttccagcagacggcccgcaacctgctgcccttcctgacggccgcccagaacgtcgccctgccgatgcagttgaaggccgacggtccccgccgcggtgcgggcgcacgccgtgcggccagggtcgcggagatcctggaggccctcgggatcggcgacctggcacaccggcgcccggcggagctgtccggaggtcagcagcagcgtgtcgcgatcgccgtggccatggcgaacgaccccaaggtgctgctcgccgacgaacccacgggcgaactggactcggaaacggccgcggccgtcttcgacaccttccggaccgtgaacaaggaactcggcgtgacggtggtcatcgtgacgcacgacccgatggtggcgggcgaggtccgccggaccgtggcgatccgcgacggccgcaccagcagcgaggtcctgcgccgcctggtcaccgacgagcacggcgaggaatcgatcagcgaacgcgagtacgtcgtcctcgaccgctccgggcgcgtccagctccccccgaagttcctggaggccctgggcatggaacaccgcgtcgcggtcgacctggccgcggaccacatcgagctgcgcccggacgacacctactgaggcgtgtgctcacccccgggatccggtggtggacggcctggtctcgaggacccaggtgtggtggcggacggtgccgggctccgcgcggccggcgaggatgtcgcagaggagcgcggcgcaggcccgcccgtattcggccgggcgcaggtcgaccgccgtgacgggtgtgtccgcgctccggttggcggcgccgtcgacgcaggaggcgaccagcaggtcggcgccgaccgtgcggccgaggacggtcgccgcgcgcagggtcccgggggcggctccgtcgggggcgcagatcacggcgtcgatcccggggtcggcttcgaggagccgccgggtgccggtctcggtgtcggctgcggtcgccgcgaacgggaccgtgcgcacggcgacttcggtcccgtacgaggcgccccaggcggccgccgcgccacgcagggcctcggcccaggcggaggccggctcgggcgcgaggagggcggggcggcgggcgccgcggtcgcgcacgtggtcgagcagggcggtgagcgaggcggcgttgtcgcagacgaccgcgccggcgggggagggggaggggccgaggtagcgctcgccggtgaccacggggacgccggagccgaggagccccgggacggcgctgtcgccgacctcggggtcgatgacgaggaggccgtcgacccgggaggcgagcgggccggaggccccgccggccggggcgagcaggaccacgtccaggccctcctcctgggcgcgctggacggcgccgaaggccaggttcatgtagtagtccagccgggtcgcggtctgcggcaggtgcaggccgacggctccggtgctggcgcggcgcagccggcgggcggcgctgttggggcggtagcccagctcctcggcgaccgcccggacccggtcccgggtggcttccgcgacgcgtccggagccctggagcgcgtcggagacggtgctcttggagacgccggcggcgcgggcgacatcgagcagggtcacggcgggtggggtcacgccccgcattctagacgttccgtccgaccttgccggaacgttccggcaaggtctacattcgtgtcctgccggaacgttccgtccgaccttgccggaacgttccggcaaggtctacattcgtgtcctgccggaacgttccggcgctgccggacgcggcctgtccgccgcactgcaccgccccccgtgccgcaccgcgcggaccgccccttgaccgatccttccgtatcccgcatcctgactgaaatttcagtcagaactccgaaagcagcccgcccgtgacctcgtacgcgctcctcacctccttcggatcaccgctcggctccccgggccgcacccagcccggcgaacgcgaaccgctgcgcgtcggcctcgtccagatgcgctggtacgccgacccggccgagcacgacgaccggctccgcgagggcgtcgccctggccgccgggcagggcgccacggtcgtctgcctccccgagctcacccgcagcccctacttctgcaacaccgacgacccgatggccgacggcgccgagcgctggctggaggacgcggcgaccggccccaccgccgctctcgcggcagaactcgccaccgagctcggcatcaccgtccacgcctccctctacgaacgcgccgaggacggcggcctcggctacaacaccgccgtctgcgtggactccgacggcaggctgatcgcccggacccgcaagaaccacatccccgccttccccggctaccgcgaggacctgtgcttccgccccggcgacagcgggttccccgtcgtcacccacgagggggcccgcttcggcttccccacctgctgggacgagtggttcccggaactcgcccgcgcctactccctggccggcgccgagatcctcgtacaccccaccgccatcggctccgaggtggacctgccggacttcgacacccggcccctgtgggagcacgccatcaccgccaacggcctggccaacgccctcttcgccatcgtgcccaaccgcgtcggcaccgagggccgttccaccttctacggctcctccttcatctccgacccctacggccgcgtcatgctccgcgcgccccgggaccggcccgccgtcctcgtcgccgacctcgacctcgaccagcgccgcgactggctggagttcggcctcatgcgcacccgccgccccgagctctacggcagcctcaccgaacggcggtccgcgcagggcgcgtaggcggtgccgcaccggcacgcattccttcccgcggtcgtcaagtcacgtgtcgtcctgccacgcgattccgtgtcatgacgggcttcgggcgccggggcccaatggtgatacggccccgcagagaaaggacgtgcccgtcatgtctaccgctcccgcccatcccctgagcgtcgaagcgacgctggatccccggctcacccgatggaagtggctggtgaagtggatcctcgccatcccgcactacatcgtgctgtccgtcctgcagatcgctttcctgctgctgagcatcatcgcgttcttcagcatcctcatcaccggcagttatccgcggcgactcttcgatttcaatgtcggcgtcatacgctggaacacgcgcgtcacctactactgctcggcggtgatggccaccgacgagtacccgccgttcacgctccgggagacgcccggctacccgatccgcgtcgacctggtctatccggagcagctgtcccgcgggctggtcctggtcaagtggctgctggtcatcccgcagctgctcgtgatcatgctgctgttcaccggcggctggcgggcgtaccagtccttcgacgactacagtccgttctcctccggtctcgtcggtctgctctccctggtcgcggtggtgatcctgacgtgcaccgggagctatccgaggggtctgttcgacctcctcgtcgggctcgtgcgctggatgctgcgggtgttcgtctacgcgtccctcatgacggacgagtaccccccgttccggctggacctgggagggagcgagccccgggcgggagcggtggaaccggcaggcggcgggaacgaccaggcgtcttaaggacccgttggggtgatcaccggggtgtccgcgcgtcagggcgcggcgccgccgcatccgggtcctgccgatggacgggaaggccgaggcgcggcggacccggatgcggtaccgcgcctcgcataccggccctgccccgtgcagcgggcgtgacgagcggccgcggggggtcactgcggtgcgacggctccggagtccggtgactgctggagtccggacgcgtcgaccgcctcgaagtccgatcccttgaagtccttcagcccgtcgagctgggcattgtcccagccggggctctcctcgccggtgatgtaccaggccgagccgttgtccgcgacgatggcgccgtacttcttgagcgcgtcggccacggccttggcctgcggggccagttgcgaggtgtccaccgagctcttgagccgcagccgcagccccatcggcggcagcgagccgtcggccgccgcgcccgcctggtgcctcgcgggccagaggtagctccggtcggagcggggcacggtgatgcggatcgcgtggtcgatgcgcccgtcggccgcctcgtcgtagcgcgccaggccggggaggatggcgagaccggcggcgtcggcggacgtccatccgtcgggccgcagggcgttggaccgcaggtcgaagacggcacccgagccggcgtgccaggcgttgccgccctgccgcttcgcgtcgaacagctcgtaggacttgcacagggccttgtcccagacgacgacgtggcggtccccgtcgctcgccggaccgttctcgatcctggcgtccggcgggatccggtacccggaggtgtcgctctcctcggcgtagtccagggacacctgggattccggcagcgtcgtgtccgagacggtgacgggaatgccgaaggggcggccttccgcgagccccgatccgaaatccgggtgcagcggctcggcggcgccgatcgaggcgacgtactggccggatttcgggtgcacgggcaggctgtccacgggggcgtgccagaaactgtccgggggtgccgtggggcaggaggccgctttcccggcgggatccgcggccccggtgagcaggcatccggcggtcagggtgacgacggtggcgacggcggggattcccttgcgtgagcgccatgccgtaatgcgcttcatgggcatcgaccgtcctcagggccgttcgaacgactcgatccccccgggcggaatgccggggattcaccggcccggctctttcggctctttcggtcgcttccgtccatgttaaagccggggaggccgagccgcccgggctccggggccgccccgtcgtccggtgagagctgcgtcacggtcggcaccggtcggccggaggtgtggaatgcgccacttgtgggggtcggtgacgaagaagccgacgcgcgcggcggccgtcgcgatcccccacaacccgcgggtggccagggcaaacgccggttcaggccggttttccgggccaatcgcgcaagcatcgcaaaatgggccaaatcgccctcttcttcccacaactccctttgttctcataagcgacttgatggtgtgtcagccttcagcgtgcgggacataatcggccccggtcgtctccggaagcagtggagccatcgggacaccgatcgacctccccggcggctcgccgcaccggaccgaccctcaaggcgccgtacatgtccctggcccgccgcacccgactcgcggccctgctcgccgcgttctccgtcggcaccgccggaattacggcctgggcctacggacacgggaccgagcacctgcaggccgccgccaaggtgctggtcaccccgagcgtgaccgagggctccgccctccagatcgtcgcgcaccccgacgacgacctcttcttcatgaaccccgacctgagccgttccatatcgacgggcatcaaggtcaccaccgtctacctgacctccggtgagtccgacggcaggaacgaggcccacagcccgcacctggaggacgccgccggacccgccgaccgcgccgcctacgcggaagcccggcagaacggcatacgcgccgcctacgcccagatggccaccggggaccgcgccggcgcctggcagcgcacgtccgtacccaccgccggtggcggcagtgccgaggtggacgtcctggtcgcccggccccaggtcaacctcgtctggatggagctgcgcgaggcccgcagcatctccggggacaacccggagagcctgcgcggcctgtgggacggccggacccccgccctgggcgcccagctgacctccgggacaccggtcaaggactcgttctcctacaccaaggaccaggccgtggccgccatagcgggcgtgttcgaggcgtaccggccgacgacgatacggacccaggacccgacccccggcagggcggagggcggcggcgccttcctcgaccaccaggaccacatgtacggcgcccgcttcgtgcaggccgccgccgagcgctacgcgaagaccacggaccggccgcacttctcggtccagaactacgtgagctacccgaacagctcgctgcccccgacgctcgacccgcagacggccgaggagaagctcggctatctcaagacctacgcctggaccgaccaccaggactggtgcgggagccccgccggctgcggcgaccgcaagaccgcgacccggcccaccggcgccggctggaaccggaccatccgctacagccgcggcgacggcacctcctggatgaccgagggcgtctccggacgcctgtgggccttcgccgcgctggacggccggatggcgtactggtcgcgcagcggcccccaggccctgtggcagggccccgagttcctgcccggcgacggcatcgactccggggcggcggccgtccgcctctgggacggccggatcggcgtgttcgccacccgcaccaccctcggcgccacgccccaggagtacggccgggaagtcgtctacgccgtccagagctcggtcgacggcggattcggcccgtggcagtcgctgggcaccccggacaccgtggacaggtccggcacctcggcgatcagcgggccgtccgtggtggtggaccccgagggccggatgacggtgtacgtccgcgactcccggcggacgctgcgcgcccgggcacaggagaccccgggcggcgaattcggggcctggcaggccctgggcggcgccggcctccagggcgatccggtcaccgcgaccgacgactccgggcggcgccacgtgtacgcggccacggccggatccgtactggcctgggtccagccggcacccggcacccccctccgcggccccgtcccgaccggactgccccagacgacgggcacgctctccgtgcgcgcggagggcgacggcgtccgcctcttcttccgccggcccgggatcggcacggtcgccacgagcctggcccgagcgggcggacccgcgccggagttctccccggtcgccgaggccggcggcctgggcggctacggcgccgtgggcatcgcgggcgacctgctcgcgggccgggcgggcgcgggcacggtcggcgtcgcggccaccgacggtccgcagccctggcaggagtcccagatgctgtacacgggcgccccggccggggtggccgagggagccggttcggccgtcgccgcggcgctcggcctggacgccgatctccacgtcatcacgacggtccccgccggcggcgccacaccggccggcagcaggacccccgccccgtggcaccgggcggtccagccctggacgctcgcccaggccggacgtccgggctcggccgtcgccgggggacagccccctcggtgacccgcgccgcgcacacccgggcggccgtggccgccgggtggcagggcggatcggggcgggcgacgatggcagccggaccacctcgcgctgctggtgccggcgcactcggaccaacgggcgatcggggctttcatgacccctcctctcctctcgtgccgtcgcttgtgcgggggacccgcaacgatgcgcgccgtggccgccctcgcggcctgcacggccctggtggccgggtgcggcaacgacaccgcgcccgaccgggggtatccggaactggggaaggccctcgggtcgctctcccgtggtctcgacgaggcctgcgcggagacggacaccccggagagctgcgcggaggacctcgacacgctcgcggcgccgacggagcgggccttcacccaggtcctggagcacaagctgctcgacgccggagccgtcgaggcgatggacgaactcgacagggcgagggaactccgcgtcaccgccgcacgcgaggcccgggcccggcaggatccgcgcgaccccgcgctcgcgcacgcggtggcggccgagaagcgcgcctaccagcgcctcctcaccgagctggagcgcctgcgcaccgccccgccgcccggtgacggaacggattcggtccgacggccgcggagctgaccggcaggacaccccctacggtctcaggggcggcgcggggagcaccccgccgtcgagcgccaccagggtgaggacgacgatcgatcccgtccaggccagtggtgcgaccgacgagggcctgcccgcccggtccaccttctcgggcagctccccgagcgcgttccgcttcgcgaggacccagtccagcacctgcccggcccgcgccgtccgccccgtacccgcccaggcgagggcgaagaacgaggtgctgggggtccaggcgttcgcgccccagggcgccgtcgggtcgtttccgggggtgagccccccgttgggcaggagcagcgcctcgtacgtggtgtccagcgcccggggcagaccggccggggccgcgttgaagggaggcgccatgaaggccaccgcgctgtcccgtccgtgccgtccgtcgacggtgcgctgatagccgagaggggcgaacctcctggagatgccggtggagagccgcccggcggcgccgctccagcgggccgcgtccgccggccggtccagctcgccggccaggtccgcggcggcgttgagcccggcgagcaggggcgccgccgtaccgatgttcgtcgtggtcgtcatcacctcccagtagtccggggaggccggaggcagcccgtccgcccccagggaggccgcggcgcggtcggccgccttgcggatcatcgggtagagggcggccagccgggcgcggcgggtggcgggcggcgctgtcaggtaccactgccaggtggcccaggggacccagccgttggcgtcgagctgccacagcctggcgtcgggcgggccggatccgtcgagctccgtccgcgcgtcccaggtaccgtccgcgcgctgggtcgcggcgctgtagcgcaggatccggtaggcctcggcgtcgtggccggtgtgcgcgaacgcggcggaggcgaagctggagtcgcgcggccaggagtacatccagccgggggaccagcccgccgccatggccccgttgggccgcagcagggcgcgcatcgccagcagggcccgctcggccgccgcccgccgggccggcgagccgcccggcacccggcccgcggccagccaggcgcggctctccgcgatccgcagacgggccgccggatcctccggggccaccacgaccgacgccgtccggccgaccggcaggtacctccaccggccggacagcagccggagcacatggctcccctcgacgtaccgcgcgcccccggcgacggcgggtgtgacgccctcggctgcggtggtgttggagaggaggccgacggtgggggcgacgagcatcgacaggggcgcgtagcggccctcggcatcgccaaggctctggtgcccgaggggccggacgaagaacaccggccgctcgccgcccgcgggccggccggccgggctcgccgcgacacacaccgggagggcgacgctcgcgaccgacgccgtgacggccgcccagcggacgagcagggcagcaggcatcgccactccttctttcgggcttgcgcgcgcacggccccggacctcccatcgtgggccggtggtgcggagcccgccacgacatacccgccgcccgggtgacgcacggcccgccggaggcctcgcgtccacgcacggagcaacgcacggagcggggccggtgcgacggacggagcaacgggccgaaggccctcggcgggggcgaggacgcccggggcgcacggcgggatcgccccgggcccggcccggcggctctccgctcggatgccggtgcacggccgaccgtgcacattggggtgaccgggtgaccggaggaagtcgctccggccgcactccgcagcgaaggacgggtgaatgagcactgctccgaccgaggggaaccgccggttcgtccgcaggctcctgccggccgcgggcggctccctcgtggcggccgccggcgccctgatcgccgtcggctgcttcctcggcctctacgtacgtcccacctcggacgactggtgcgccgcctggaagtcccgcgacctgggagtcctcggcatcacgcacgacttctacgccacccagaacggccggatcaccaacgccttcctgagcggcatcatctacggtgacggactcgccggggtgaagatcctgcccaccgtcatcgccgtcgccttcaccgccggcctggtccttctcgggatccggttcctgcgggcgctcggcgtgaaacccccggtgctcctcctggtcgccgccgccctggccgtccaggccgtggtctactacggcggcacccgcagctatcaggtcctgctgtgggctccggccaccatctcccacaccattccgagcgtcatcggggtctgggcgctgctgctggccatctggacggtccggcaggagcgggccgccgtacgcgcgggcggcttcgccgcggcgttcctcatcggcttcgcgatcggcaccctgagcgagtcgttctccctcgtcagcggactcctcgcggtctgcgtgggcctgctggccgtgccccgcctcaaactggcgcggacctggtacccgttcacctggtgcctgctctggtgctccggagtcgccatcggtctgatcgtgctcttcacgtcccccggcgcccgatggcgccgcgcccagcagccggccaaggagtccatgctctccgcgggcgaactccggggtacctaccaggactggctgcacatgtgggacaccgtcaccggtcagtgggcctacctcggagccgcggccgtcggcgtcctgctgggcctgggggccgggctcgcggcgcccgtgcccgcgcccgggaagcgggagccgggccgggcgtccgtcccgcgcaggacactggtcgccctcttgctgctgccggtgcccgtggtggtgctgggttcgttcgccgtggtgctggggctgcgcagcggctacgggccgaccggctggacgtatgcccgtacctggacgaactatctcgtaccgatggaactggcgctgtgcgcctacggcgtactgctgggggtgtgggcccgccggttcctggcgcgcccgggaaccgcagccgtcgccgtgccggcctgcgtcgtggtcgcggccggcctgaccctggcgtcgctggccgtactcgtcccgagcgtgaaacagctgaccaccgccacggtcacccgggcggtggcctgggacgcccagaacgcccgcatccggacggaggccgcggccggtgccggcgacctcgggtaccagcccctgtacatcggaagcctggccgagcccttcttcacgtccgactaccggcgggactgggtcgcggtctgtgtctcgaactggtacggcatcgagcggatccaccgcctgtgagcacggccgtgccggttcagccccgcgccaccgcacgggccaggaagtgaccgggggcgtcctcgtacgcgtccaggtgccagcccgcggtctccagcgcgccgcgcaggttgccctcggcgaggaggtcgtcggggtcgagcgggcggccgtgccgggcggcacgctccgcgcggcccgacgggtggaagagcagcaggacaccgtcggcggcggtcacgcgggcccattcgcgcagcgcggcggccgggtccgggaggtggtcgagcagccccgcggagaagatgccgtccacggacgcgcgggccagcggcagccgggtgcagtcggcggccaggaggtccccgtggcgggtgcggccgtgccgggccgcggcggccagcatggccggggtgaggtcgacgccgagcacgtgcccgcgggggccgacctgcgcccggagcgcgggcatggcccgtccggtaccgcagccgaggtccaccgcacgcgtacccggtgccagtcgcagccgggcggtcgcggcctcgtaggcgggggtctggtaggcgaaccgctcctcccaggcgtcggccctgcgggtgaagaaggcccgggtggcggtgtgttcggcgcgggccgccacgagggtcgcgaaccggccgaggagctgctccccccaggggtccaggcggagctcctgcggcaggaagcggacgccccaggcgctggcgccgatccggaacgcctgctcggggtacccgtcgcaggaggccagtacgacggcgtcggcgggcagttcgagggggtcgcgggccggtcgcaggccgggggagggccgggcggacccggcgaacagcgggtcggtaccggcggcgcgggtgagttccaccggcggtcggtcgggggtggagtcgggcagggcccccggggcgtcgcccgccgcccgtacgagcagtcgcgtaccgggttccagggccagtacgggtacttccgcggcgagggcttcccgcaggagcgccggatcggcggggcccaggacgatcaggccctccaccccggtgaggccggcggacggggcggcgtcgtccgcgagcggcacggtccgggaggtcagacccgcggcggcgagcacccggctcacggcggtgggcgcccgcccggcctcctgctgcacgacgactaccgccatacctcagtccttacattcgagctggtgtggctgtttcgagctgtatctgcgcaagcatgcccacatggaggccgcatgtgccagaggcgctccggtccgtgagacgggcggccggaacgcaaagaggcccccacgtgccgaacttgctctgttctcgtggcgtgtgcccgcttgtcggagagctgcggggtggagggtcacaggggtacgagggtgatctcggtggccttgacgctgcaccacaccgcggtgccgtcggcgatggcgagctcggcggccgcctggggggtgatctcggagacgacgtcggcggcggcctgcgacgtgacgaggacccggagccggctgcccgccgccgtgatctcacggacggttcccggccagacgttgcgcggactgccggacggctgctcgcggtggagggagacggcctcgggcgcgacgatggccagggcctcggagccctccgccacgggttccgccaccacgacggacccgccggcgaccagcttgagcccgtccaccgtggtcgtcccgggccacgcgttgcggccgagcatgcgcgcgacccacggggagcgcggattgcgagtgacctccgcgggcggcgcgtcctgcaggacgcgaccgtgggccagtacgaggacccggtccgccagggagacggcctcgacggggtcgtgggtgacgatgaggcagaccccgccgaagccggccaggtgggtgcgcagggtgtgccgcacccgggcccgggtggtctggtcgagcgcggccagcggctcgtccaggagcagcagacggggctgcgcggccagtgcccgggccagcgccacccgttgggcctggcctccggacagctgcgcgggcctgcgctcggcgaggtggccgacgccgagccggtcgagccacagccgcgcccgggagcgggcctcggcgcggctggtgccctgcgcgcgcaggccgtaggcggtgttcccgagcgcggtcaggtgggggaacagcgcgccgtcctgggggacccaggccacgccccgccggtgcggcggcagggccgtcacgtcgtcgtcgccgagccgcagtgcggcgtgggcccgcggggtcaggccgagcagggcgcgcagcagggtggtcttgccggcgccgttctcgccgaccacggcgatcgtggtgccgggttccgcgtcgagggtgagctcggtgaacccggtgacctcggcatgcagggaccagcggccggccggtgcggagccgtcggccgggtccggctcgggggcccgggcggccgggtcctcggcgggcgtcgcgtgaggggtgtcccgtacggcgtgtccggaggtccagcggccgcgcagggcgaccagcaccgccatcgccacgacgagcaggaggagggacagcgaggtcgcggcctcggggtcgtcctggagcagcaggtagacctggagggggagcgtctgggtgacgccgggcaggtttccggcgaaggtgatcgtggccccgaactcgccgagcgcccgggcccaggtgagggcggccccggcgatcaggccgggggccaccatcggcagtgtgacggtgaagaagacgcgcaacggggatgcgccgagggaggccgcggtctcctcgtagccgggtcgcagcccgcccagggccccttcgaggctgatgacgaggaacggcatcgccacgaaggtcgccgccacgacggcccccgacgtgtggaacggcagggtgatcccgaaaatgtcctccaggaaggggcccagcaggccgcgccggccgaagcccagcagcagtgcgacacctcccaccgtcgggggcagcaccatgggcagcagaaccagggaccgtacgagggtcttgccggggaagtggacccgtgccagcagccaggccaggggcacgcccagcagcaggctgagacccagtgcccagaaggacacgacgagggagagccgcagggcctccagggagccgggtgtggtcaggtgcgcgcggagctcgctccactgcgtgcggacgaggatcccgacgagcgggagcatcaggaacgcgatcgcgaggagcgcgggcagggccaggaggagcggcgggcggggcccggcggtacggcgcacggtcacggctgctggaagcccgcctcccggagggtcttccgggcctcgggcgaggacagccactggacgaaggcgtccgctgccgcggcgttcctggtggccttcagcgtggcggccggataggaggcgacggcgttctggtcgtccgggatcccgaccgcgccgaccttccccccagccgcggtcgtgtccgtcgtgtagacgaggccggcatccgcctcacccagctccaccttggacagcacggcccgtacgttcggctccagcgagaccggatcgacggtgatgccctgcttgtcgaggacctcccggctgtagcggccggcggggacctccggggccgccaggacgaccttcagcttcggatcggacaggtccttcagggagccgatcgtgtgggggttgcccggagcggtggcgatcacgagctcgttcttcgcgatcaccgtcggggtcccggtctccgccttgaggccgtccatcgtcctggtgtcggcggtgaccagggcatcggccggagccccctgcctgacctgtgcggccagctcctgcgaaccggcgaaggagaaggtgaccttcgtgccggggtgctccttctcgtactgcgaccccatggtcttgaacacgtcggtgagggaggcggcggcgagcacggtcagcttcgcggccggtacggagcccgacgcggaagcggtcggagccgcggccgcggaggtcgcggtgccgccgccgctgccgcaggcggccaggacgggaacgaggagggcgccgccgaggagaccggcggccgcccggcgcagtcggacgtgctgaaggaagcgcatggcggaatgtgttctccggtccggtcgtcctcaccccgcgcacactcggcacgaggtgcggaaacgatgcggcatttactgtcaatggagcaccgaaaggcccgcatgtgcaattcgccgatcccggccggcggggtgcgggttcggccaaccgggtcggaagtcccacgtcaagcaggagaagggccccgaaagagagaggacttcgggcctttccggaatgcgccaggaggttgcgtccattcggttggcgcatgcgatgggggcgccccggacgccattcctcatcgggtacgttcggccatgacgcgggtcacagacgtgcttgcgcttccgtttcctgaccgccgcgatcaccaagggcgccgtcgaggccctcggcctggcctccgttacctccgtcgtcgccctgatcaagtcgaccgagatctccctcgcctccgcctgatcctcccgcggccccggctgtgtccagggcgcggacgcgcgggttcacaccggcggtacgccggaggtgagcggatcggagcccaaccgcaatccgtgcggggggaggcggaaacgccccgggccgacagtcgtgtccatgcctccgacgaccgcgcccgccccggcctccgcccccgtgccggcccccgcccccgcctccgcgccgccccggatcccggcacggcaaccggcggtgtcctgggccgaggcccggctgctggcccacggcgcggcgcgcccgctgaccgcccgtacggtgcccctgcgcgacgccgccggactcgccctggccgacggcctggccaccctccagccgctccctggcttcgacacggccgccatggacggctacgcggtgtccggcaccggcccctggcggatacgggccgccgtccgtgcgggcgcaccctgggcgggcgtactcggcccggcggaatgcgtggagatctccaccggggccggggtaccggccggagcccgcgccgtgctgccgctggagtcggcactgaccacggccgacggccgggtgtccggccccgtgccgccgcccggccggcacatccggcgtacgggcgaggacgccccggccggccgccgactcgcccccgcgggcaccaggatcggtcccgcgctgctcgggctcgccgccgcctgcggccacgacagcctgcgggtgcggccgcgccccagggtcggcgtactggtcaccggggacgagctggagcacacgggcgttccgggccccggcagggtgcgcgacgcgctcgggccactgctcccggccctggtcgccgaactcggcggcgagaccgaaggggtgcgtcacgtccccgacgggccggccggcgcatcggggagcgggctgtccggggccgtgcgcgcggtacggggcgccgacgtcgtcgtggtcaccggctccacctccgtcggcgccaccgaccagctgcgacggctgctggaggccgccggggcgcggatggtcgtcgacaccgtcgcctgccggcccggccacccgatgctgctcgccgaactggccccggaccgctgggtggtggggctgccgggcaacccgtacgccgccctggtcgccgcccgcaccctgctcggccccctgatcgcggccctgtccgggcgcaccctcgatcccctgccgtgcgttccggtgcacgggcgggcgcggcccgcacccggagcgacccggctggtgcccgtcgcctgggacggcgcgcgggccaggatcaccgaagggcacggcgccgccttcctcaggggggccgccgtgggcgacgcgctcgccgcgctccccccggactggaccgacggcggtgcggcgcccctgctcctgacggccggctgacggcccggcgggcgactgccgggcccgaccccgttcagacgaggtccagcagccgcttgtacgagccgccgaaagcgccggatccgtcgaccaggtggatctccaggagccagtgggcctgccagcctcccttcacggtccggcgcaggggccggtcgttctccgcgcagatgtacgcgtccgggggtgcggcccggccgtcggccgccggatccgccccggccaggtgaccgcagtgccatccggcgaccgtccagcccgactcggcggcgagcgcgaggacctcggcgtgcaggcgcccgcccgtgatgcgcgcgtcggcgtgcagggcctcgcggcaggcggtgaacatcctcggcatgtccagggcgagccggtgcttgtcggggtcctcgccgaggacgagggtcgaggcgaagcccgccccggacgccgcgagcaccgaaccgagttcggcgacgacgacagtcgtcctcgcctatcacccggtccggggtctccgggccgtacgggagcagggtgcgcgggcccgagcgtacgagcggcccggtcgggcgcgcggccgggccgaacagttccctcgccaggtccccgatccggtcgctcgcctcgcgttcactgcggcccggcgccacaggccgcgggccgcggttccggcgaacagggcctcggccatgcgctgggtctccaccagccccagggcgcgcagccgttcgtccatccggtcgggtgctgacatcgcgttcttcctcttcttccgcttcttcccacggggtcgcgcgcacgatcacgagcgacccctcgtaggtcggcctgccgcgcagatggccgaattccttgtcccaggcgccggactccagtccgcgcggagggtcgtgtcgaagtgctcgcggacccggtcgtcgacgaagctccaggccgagcacgcctggcgggcggccgggtcgagcagtgcctcagggcggccgtagtaggcctcgttgaatccgtcggtgcagtccagggggatgggcacggtccggacggtgccggatccgcccggggccgaggccagttcttcgacggtcgggtggcgcagggcctcgatgtcgaggacctcgggcgcgtaccggtacagccagaagtcccggaccaggacggggtcgcaggtcaggatgtccaccggcccgcgggtcacgcgccgcatctcgcgcagcccggcccgtacgtcgggccactgacggacgccgaacagggtcatcgccgcgtcgaactcgccgtcggcgaaaggcaggtcctcggtgacggcgccgacgtcgaggacggtccgggagtcgccgagggcctcggcgatgaaccgggcgatgcgctcgtccgggcggcgctcgggggagcggccgccgacggcggagccgatggcgcgctcagtacacgtcgcggccgtaccgcttggcggcggacagctgcttcaggtacgcggcggcctcgtccgcgtcgaggccgccgtgcgtcatggctatctcgcgcagcgcccggtccacgtccttggccatccggctcgcgtcaccgcacacgtagaagtgggcgccgtcctggagccaggaccacagctgggcgccgtgctcgcgcatgcggtcctggacgtagaccttggtccgctggtcgcgggagaaggccaggtcgagccgggtgagcgtgccgtgccggtggagttccgccagctcctcgcggtagtagaagtcggtggcgcggcgctgttcgccgaagaacagccagttcccgccctggtggccgagcgcccggcggtgttcgaggaaggccaggaacggcgcgacgccggtccccggaccgaccatgatcgccggggtgtcggcgcccgcgggcgggcggaagtgcgccgaactctgcacgaacagcggtacgggcgtgcccggttcggcgtcggcgaggaaggcggaggccacgcccttgcgctgcccgcccgccggcccctcgtagcgcaggaccgagacggtcaggctgacggcacgcgggtcggtgagcgggctggacgagatcgagtagaggcgcggcttgaggcgtcccaggcgctcggtccactcctgcgcgctcagccggaccgggaactcggacaggacgtccacgggctggcggccccacgtccaccgggcgaggccgtccttgttgtcggggcgggtcagccgcttgagcgtgcggtcgccggtgtgctcggtgacgaagcgcagcaggtcgggtgtcagccgggtgatgtccaggtgccggtggagcgcctcggcgaacggcatggggtcgcggcccggtacggcgacctctgcgtccggggagaggccggtggcggccagccattccgtcaccaggccggggcagttgaccggctgcaccccgagcgcgtcgcccgcctcgtacgccgggccgtcctcgccgagatcgaaggtgaacctgcggacctccttggcggccccgggcaggctgagcagccggttgccggacagccgggcggtgtgcggggagttgcggtccgccgcgcgccgccgcgtcccggtgctctccgcctccggggcggccgcgagtgcctcgcgcacctgctccagccaccgtcccgcgggctcctcgtagtcgggctcgcagtccacgcggggcaggaggcgccggccgccgagttcttcgaggcgctggtcgagccggcggccgtggccgcagaaggcgtcgtaggtggagtcgccgagggcgagcaccgcgtaccggacgtcctggaggcggggtgcgtcggcggcgctgacggactcccagaacgaggctccgctgtccggcgcgtcaccgtcgccgaaggtgctggtgacgatcagcagatcggtgcccggggtcagggcggcggccgtgcggtccgccatgctgtgcacgctcgccgggaggccgtgcccggcgagggccgctccgacggtggccgcgaggtcctcggcgttgcccgtctgcgaggcccacaggaccatggtctgccgggtcggcggggccgggtcggcgggcggagcggccggagcggtcggggaggcgccgaccagggcagcggccgtacgcgagtacgtaccggcgagtgcaccgtcgacccagagcgcgtgcccggcttcgaagggggcgccggccggaagcgaggggacaccggtgccgggcggggcggaggcgagcccggcgaggaaaccggcgaggtaccggcgctccccgtcggagagggcgggcggggcctggtcgtccagcccgaacaggacggccagggcggtcgtcgcgggggcggtcgcggcgagggccgacacggtggtggcggggccgccgcggccgggtcccgatccggcctccgcgccggatccggcgggcagggccgccaccggggccggggccggggccgggaccggggccggggtccgtgttctggtcaaggtcaccgcgcacatcttgaatccgggctggaaggagatcgggtcgacggcgtcgtcggtgacggcgttgacgctgaggtactcgccgaacaggtcgttccagtggaagggggcgaagcagttcccgggccggacccggtcggtgacgacggcgggcagcacggcccgcccgcgccgggaggccacctccaccccgtcgccctcctcgataccgagcgaggccgcgtcctgcgggtggacttccacgaacggtccggggttgagcttgttgagcttggcgaccttgccggtcttggtcagggtgtgccactgatgctgcagacggcccgtgttgagtacgaacgggtagtcgtcgtcgggaagttcaccctccggcaggtacgggcgggcgaagaagacggcccgtcccgtcgccgtcgggaagaccagccgggggcggccgccgtccgggtgctcggccggggtctggctgaccccgtcgttgacgtagcggatcgggttgcggtccgggccgccgggggcggccggccactgcaccggacccgagcgcagccgctcatacgtgaccccgcgcaggtcccagcccgtcttcgggttccaggcccgccggagctcctcgaacacctcctcggcgcacgagtacgtgaacgcctcggcgaatcccatcgcgcaggcgacccgggcgatcagctgccagtcgggcagggcctcgccgggcgggtcggcggcgccccgcaccagggtgaggttgcgctccgagttgatcatcacgccgtccgcctcggcccacagcgtcgcgggcagcgcgatgtcggcgtaggcattggtctcggtctccgcgaacacgtcctgcgtgatgacgagttcggcggtctccagggccttgatgacggtgctccggttggcgacggaggcgaccgggttggtgcagatgatccagcacgccttgatctcaccggcggccatcttctcgaacatctcgacggtgccgcggccgacgtcggtgcgcagggtgcccgccggaacgccccacagcgcctcgacgtagccgcggtcctcctccaccaggaccgagcgctggccgggcagccccggtcccatgtagcccatctcccgtccgcccatggcgttgggctggccggtgagggagaaggggccgctgcccgggcggcagatggcgccggtggcgaggtgcaggttgaccagcgcgttggtgttccaggtgccgtgcgtggactggttgaggcccatggtccagcagctcgtccactcgccggcttcgccgatccagcgggcggccagccggatgtcggcctccgggatgccggtgatccgggcgacccggtcgggcgcgtagtcccgcaggaaggccggcatgtcctgccagccctcggtgtgctcggcgatgaaggcggggtcggtccagccaccctcgaccatgaggtgcagcaggccgttgaggagggccagatcggtgcccggccggatctgcaggaacagatcggccttgtcggcggtggcgttgcgccgggggtcgaccacgatgagcttggcgccggaggccttgacgcggtccatcatccgcaggaagaggatgggatggcagtcggccatgttggcgccgatgacgaagaaggcgtccgcccggtcgaagtcctcgtacgatccgggcggtccgtcggcaccgagcgagagcttgtagccgctgccggcgctcgccatgcacaggcgcgaattggattcgatctggttcgtccgcaggaagcccttggccagcttgttcgccaggtactgggcctccagggacatctggccggagacgtacagcgccagcgcgtcgggaccgtgcgcgtcgaggatcgcccgcagacgcccggccgcctcggtgacggccgcctccaccggggcgggagcgggcccggcgccccgctcgccgcggaccagcgcggtggtcagccggccgggcgcggccagcatgtcggcgtgcgtcgcgcccttggtgcacaggcgcccggcgttcgccgggtgccgcttgtcgccggcggccttggccaccgtacggcgcccgtcgccgcccgtggcgatgtccaggacgatcccgcacccgacgccgcagtaggagcacaccgtacgcacctgctgtccggccgcggccttcgcccccgcctccccctccgccacagcagacctcctcgcgcctccggccgacaccgttccgctccgggccgctgcggccgtgtgcaggtcggtccggctgcggtccaacgtaggaagtccctgttgcgcgcaggtgacgggcggtggctcccgggggttacaagcggcttcgccaagatcaccacgggcggtgaggtggtcagcgcccgtgcgcgtcgaggtgctcgtagagcgcccggtgcccttcggcggtggggtgcaggccgtcgacgagcagctcggtcctctcccgcagcggctcccacaggtcgaggtagtcgatgtggttcgcctcgcaccaggcccggaggaaggcgcgcagggccagtgcgcgcgcccgggtgaagcgcaggccctcgtagtcgcgggtgcggttctcgtcgagccaggacggcccggcgacgacgagccgtgcgttgtggtcgagggcagcggcggccagcgcctcgaggctgccggtgagccggtcgatctgtgcggtgccggccgtcccgtcggcctcggtgccggcgtcggccgccgcgccggtgaggggcacggcggagtcgttgatgccggcggcgaccaggagggtgtcgggccggcgggcggccagcagcgggggcgtctgctcgccgacgtcggcgagggtgctgccggggaccgccaggttgaacaggcggcgctcggcctcgttcgcggcgatgtgggcggccgccaagtggcccgtccagccgccccgcgggtcgcagcgtccgtaggcgatgctgtcgcccacgacgacgatgcgctccgccgggcgcagcggcctggcgtccaggtaggcccaggcgctctcgccggaggacaggaccacacgtcggcgggcgtagtcgtcgacctcgtaggcgtcggccgcggcgagctcctcgtcggtgaggtgcagtaccgagccctcgaccgaggcgccgagcctgcgctccaggatcaggtgcacgtcgagcccgctggcggcgatcacggccggatcggtgatcttcaggggccgggtggtgtagcccgccagcgacgcgggggaggtggggacggctccgccgaagagagcggtctggacccgctcgtccatcagtgtgccgaaggagaacagggtgtgcgtgcgtgatgcggtcacagtgcgccgtcagggcctttcttcacggagggtcaggtttcaccctaacggcccaccggcggtcggccgcggcgccgggacggcggtcgcgtgccgcgcccggagcacggccgtacgagaacctgccggcgagctcaccgctgcgcggcccggccccggccggactgggccgcatgacaacgccccctgcggacccgggagtttccgtggccgcatccaggggacgcggccacgcggccgctgcttcactggctgccgacgcccggggccgggccctggttccagcggccccgggcctctccgcaccgtgaacggtccatgtgtaccgaccgaggtggccagtgccgtgcggggcgggcgcgccggacccctacgtcgcgcgcgtcttgtccgcggcgccggcccgggggacaccgtcgaccgccgtacagatgccgtagacccggtcatggccggtccagccgttcacccggccccggttgttgctgatctgcacccgcttgcgggccggctccaccgccgacaccaggtgcaggtacaccgtcccggcgacgcgggcgaggacgatgtccccgaccttcagcttcgacgggtcgaccggagcgaccaccacctgctgacgacttcgtatcaacgggaccatcgaggagccggtcggccggaactccacggtggctccgcccgcgaccctctcggccaccgcgtccatcgcacccatccgaggatgctcgcagaccgggccgccggaccccaccgatttacgcccgcgcccggtacggcggcctcgcggtgtgtctgcggcggtccgattccggtgggcggtatggatggggggtggtgtcggaggcgtgagcgagggagcggcgcgtggcggccatggtcggactgttctgggtcactccggacgcggtgtacgtgggttcgccgccgaacgccatcgggatctgcgtccggctgacctcctacgggctggaggccgcggacccggacacacccctgtcgtggagctgggcggagctgcgttccgcggtggtcgaggacgtgcccggacaccacccggtgggccgtgccgcgaaactcctcggggcgatgttctcggccgcgatcggaggggagttcgccggcgaggggccgcccgagatgaggctgcggctggagacggacgaagggacgcgggaggtgaccgtccacgcggcggcggccggaggctacctcaccgaggaggtacggctctcccaggacctcctcgaccgcttcgtggcgggaacggcagacccgcgggccgtcgaggagtggggccgggagcacgccgcggagggcacccccgagccgcgcgtacgggagaccctgctgcgcacctgggcgcagccgtagggcgtgtccggcggatcagggtgaggacgactcctggaggtaggcggcgatcatcgcgaggtcgttcgcgatggtcagcacctcggtggggtcggcgcccggcgtcgaggcaccgttgacgcccgcgtagaaggtgtcgtagcggccgccgcccttgtccaggtagcccgcgatggtgatggcgcccacggccagccggtcgttgagggcgtcgccgccgacggccgcgccggtcttggcgaacacctttccccgggccggacagccgcggcagttctcggccagcagaccgtcgaccccgaggatcggcagcgcctcccggaacagccgcgcgtccggggtccgctgccagtacgccagcatctgcaccagcacctgcggagtggcccggtcggcgggattgccgccccggccgtccatgagctgcgcctgctcgcggtcgacgcccgcctggtcgaggaagtcggcgagcaccgggaagccggccgggcactggttgctgtgcgcggtgccggcgaggaggcagatgcccaggttggcgcccaggttgtggctgaccttgaggatcagcttggcgtactgggcgtagggcggggaggtgtacgcggccacccgcgggcgtccgtcgtagtcgcgcggcagccgccccgccgggttggcgcccgacgggtcggccgtgacgtgcacccccgtgcgttccagcgcctcgatcagcgcgacgcgtccgaaggcggccgggtcaccgatcggggaggtgcgcagcagcggttcggagcccgccgcgatcgttccggtcagccggatccgggtgccgccgtcggtggccgtcaccgtgatcgcggtcggtttcccggcagccaccgtcttcaccgccgaggtgacctcgtagggcgcgaccttgggccgccagtccagccgggcgtccgcgccgggccggttcccgggggtggtcatgaggtcgatcaggttgtcgttgatgatcagcggcgtcggggtggggacgagctccgggtcggggaggaacagccggctgtcgacgatcacgtccccgtcgacgcgggtgatgccggagtcgcgtacctgccgggcgagctggtcgatcccggcgagcgggttctccggggtgagggtcgcgccggggaagtcgttggcgtaggtgtggtcgaggtcggtgtacgcgaccgtgccgtcggggcgggtcctgccgcccatggtgaggtcgccctgggccacgaggtccaggtcgccggtcagggtggccccgtcgcgctcgccgaccgcgtagagcggggtcacgaagcggtggtcggcgccgagggtgtgccacgggcccgagacgctgatcagtttggccgtggaccccgggatgaagaactgctcggggaagaggctgtgcaccacgcggccgtcgtccgggtcggtctgcagcaggccccactgggcgttgcggtagtcgggcttgcgcatgatcgccgtgatgcgcggatcgaggccgccgaggcccgtgtcaccggacgggggcggcgtggacgcggtcggggtcgggctcgggctcggcgtcgggtccgcgccggtcgcggtccccgaggcgagggccacgaacagcagggcggcacaggccgcggccgtaccgcgccgtagaggtgcggggtggatcgctctgctcacagcgcgctccgttcgtcgcggctgtctcctcccgaggccaggaaacagcgtggcacggccgggccgcgcgggcacgccggacgggttcactcctcggtgggcagccagcagccgtgcaggccgagcggcacgcgtacggggatacgggcgcgggccaccgggccggaggcggggtcctccgcgggcacgaccaggaaccagctcgtgccgtcggtgcggtccgtggcgaaggtcagccagtggccgccctcctcggagccggggtcgggggcgaagaccggctcgccgacggagaggttccccgccgcccagacctgggaggtgccgctctcgccgtcgtaccagcgcacggcgtcgtactcgccgggcagcagctccgtccgcccggtaccggtggccagcgcggtgtaccggtggcgccggccgatgcgccggtcgtcgacccgtgggaactccacccgggagtcgtccagcagggtgcgggccatgctgccggcgaccgggtcgaggcgtgcccgtaccaggccaccgccggccggttcggcgtcctcctccggggcgccgacggtcagcctgctccactgcacgtagtcgaggaccaccggggcgtccgggcccgggccgtcgtcgtacgcgttcacggtgtgccacgcccagaaggcctcgtcggccgcccagcgcaccggtccgccgtcgcgggggatcatcgccacccgggtgccgcgctcagggcgccaggccaggaaggagccgcccgccatggcggcgtcgaggtcgaagaaggccggggcgaggatgaggacggcatagcggtccgtcagggccatgtcgtggatcatgatcggctcgtccaccccgtcgacgggggtgggcccgcggccgaccgtgccgtcgcggtcgatgacggaccaggtcaggtagggcggctccaggccgtagcagaagacgaccatctcgccggtgaccgggtcgaccttggggtgggcggtgatgccggcgggcagggccccgccgaagtcctcgcggcccagcgtcgcgaggtcggcgtcgacccggaaggggcaggccgattcggcgagggccagcaggcggccggcgtgccggacgacgttgatgtcggggaggtccttgaaggtgccggcgagctccggacccacctggtcggcgtccgggacgaccatcgatgcgagcccgccccacagggcccgcccggctcgttcctcggccagcagcgcgggggtgcgtacgaaacggttgcggtagcgggcccggccaccggagacccggacgccgtgcagcatgccgtcgccgtcgatggggtacaggtacgagccgatcggcgtgaaccgcggattggggccgttgcgcacgtacaggccgtccagggtgtccgggagctcgcccgtcacctccaggtccgcgacgtcgacctcctcggacacgggcgcgaaggatcccagcaggtgggggacgcgggtggggtcgaagcggggcgacacgtacgtgttcacgggacctcccgggtgcgggtcctccgcgggcgcgctttctgtacggcacctcccagtgaaacgcgcgccgggtgcggcggccaggcggacccgggcgagcgccggcggcctctggggcttggggcctctgggggcctctggcggccggggcggcctcaggtggacgtgaagagtgcctcgtgcacgccgtcgaggacgaacccgttgtcgaagcggacgcggaccgtcacgcgggccttctgctcctggaaggcgatccacgcgggttccagcgcgcggaccttctcctggagctgccccctgctgccctcgggcatctgatggccgaacgagtcgaggagcgacttcaggcgctcgtactcgcggacgtcctcaccgctgcgcggctggtgctcgtccacccgttcgaccgtgccctcggtgcccgccgccagcgccaggaagcccgcgacggcctccccctccgccgcgaccgaaccggtcagcgtcacgtccgcggccagcctcacccggaggccttcgttcaacgtcatcgatccttcatctccccggtcggtgcacgagcctatcggtggcccgctcgccgggcccggccggcaccgctcggtgacggacgtcaggggcgggtcgacaggtggtcggcgacggcctcgtgggtcaggtggagacccgcccgcaggacggcgtcgtgccgggtggggtgggccgcacggtgggcgaggtccaggccgcgggcccgttcgaggtccgcggcgcagtcctcgccgcgcagggcggcgtcgagcgcgcgggcggtggcgcgcaccagcggggcgaggtcgcgcagggcgggatcgggaggcggcgcaccggggccgggcggcggtgtgccgggaccgggcggcccgccccggccggtgtcgccggtggtcccggtggtcccggtggcacgggcgcgctcccggagctcctgggcgaagtactggagggtgagggcactgcgggcggcgagccgcagccgcgccccgagcccgtcgggcgggcggctcggggcgcgcacgtacggccgggggagccgcgcgcgccgggcggcccggtcgtaggcggcgaggccgtcctgcggcagcgtccacggcactgccccctccgggagctccggggcggtgggcggtccgccgccggtgagccgggcggccaccgagccgaggaggccgccgacctcgctccggtacgcgtccagcccggcggcggccgaccggtaggggtccggcggccacagcaggggtcccagcaggacgacgcaggcgatgccgaccacgctctccaccaggcgggccagggcgtagccggggacggcggtcgcgtagatcaccagtgcggtgatcaggacctgctggttgggggcgccgtcccggtacatcaggtacatgccggcgcagccgcaggccagtaccgcgaggaaggagaccgaggccgccgccgacgccgacgtcacggaggaggccgagggcggcggcagccagtgcagcacgaacgtgctcagcgccacgcccacgacgacaccgacgagccggtcccaccccaggcgcggggcggcgtacacgtcctcacggaggatcagcacggcgggaagggcggcgggcaccgggaccgtgctcgtgccccaccagaggcagaggaaccagggcacggcggcgcatacggccaggcgggtggcggtacgcagccgtgcgcggggcggcgggttgtgcagaacggcgaccgtaccgggcataacggacatcgtaggcctgtccggccggtccgcggcgacaccctcgacgggacggccgcccccacccgtgattccggcgcgtgtcacgcgacccgtaccggaacggcggcgcccgcccggtgagttcggaggtcctgtcgagcacatccacgcgtacctcacgcacgtcgggccgtacccctcgggcaggatgtgcggatgcgtacgacggaactggcagtgagggcgggggcgctggccaccccgggcgagcggcgtgtcctgggcatcgccgggcccccgggggccggaaagtcgacactggccgcccggctcgcggacgccctcgggccggaccgggccgtggtggtcccgatggacgggttccacctcgcccgggccgaactggaccggctgggccgcgccgaccgcaagggcgccccggacaccttcgacgccgccggttacgtcgccctgctgcgccggctgcgcgcaccgcacgggcccacggtctacgcgcccgccttcgaccgttccctggaggagccgatcgcgggcagcatcgccgtacctccggacgtaccgctcgtgatcaccgaggggaactacctgctgcacgacgcgggggagtgggctccggtacgcccgctgctggatgaggcctggtacctcgccccggccgaggacctgcgccgtgaccggctgatcgaccgtcatgtgcggcacggcaaggaccccgcgtccgcgcgtgcgtgggtggcccgctcggacgaagccaacgcccgcctcgtcgcccggggccgccaccgcgcggacctcgtcctcgacaccggctgaccggaccgtccgtcccgcctgtcagtggtgagcgtcatcatgggggcatgaccaacccgaacctgtccgacggcagtgtctggcggctccaccacggcgaccgggagatagcccggctgagcgtggtcggcgccgacatgccctggactcacgccgaggtggtgacacttcccggcttcgaggagttccgcgccctcttcgccgagcaggagcgggccgtcgacgaggaggactgggagcgggccgacgactgttacacccggatccgcggtgcgctcaccatgacgttccccgacggcagcccggtcgccgagttcatgctgcacatccacgcggaaggcaccgcaggctggcgctggcacgacgagccgttcgacgcggtggacgagtgacgcgcaggctccgctgcttctgggacgaggaagccgtctggttctacttcgagctggacgccgacggctacgtgctccggcaggtggagctgcacgagcccgacggcaaggctctggccgccgcctcactggccgaatggcaggaagcccaggacgcgggccgggcgggagagtacgagagcgtctacggtctgaccacgtacgtaccgatctccgagtgggaggggcacgacccgcagccggtgtcggccgatgagttcgcgaccgtctggtcgacggcccgtcggcagcttcaggcgcgcggcgtgggcccgcgacggccttgacgtgggcccggcgggcgctgcgcccgccgggtgccggccgcgctcaggggacgcgccagacgttggcgaacgccgcgttctcgatcgatcgccgctggcgtacggcctccagttccatcaccgcgtcgccgacgacggccagtacggtcgtcaccgcttcgtcgtccaggcccggctcgtcctcggatcgtgggccgcggatgcccacggtcgcggcgagggaggcgaggacgggctcgtcgtcctcccagcgggtccgggcccgacggagggctggcgtatcggccacctccaggcgatcggtgccgaagggcagcaggccgcggcgtccgcgcgtcagctgaccggcctcctccagggtggcctggtaggaggccgagagctcacggccgcggcgccacagccagtcctcgacccgctcgtacggtgtctggcgggtgagcgccgacgaggcctcggccagcagctcgtcgtcgagcgcgggctgcccgcccggcacgatgcggtcgccgtccaggacggcggcctgcgcgtcgaggagatcgatcagctcggcgcccgcgagggcgagcgacagatcaccctggcccaccgaatgatccggctgcgggtccatggcgatgatgaacaggtctttcgccgtgctcatgaacggctcccctcggagtcatcggaagtcggatcccgctgatcgccttcctatggtggcaccaacgcccgcaggtgaccccgggttcccgtgcatcgcccggacggacgcttcggatcggctactcctccagcagggcctggcccgcatagcggcccggcggggcgcctgcgggggcggtgccggctttcgacctcgcccgcgatccgtacctcaccaaggggacctgtggctctgcgagggaacgcgaggccccgtccgtccctcttgcctggtgcgctacccgctggtagcgctccgggcccgagcgtccggatcgggacggcgcagagagttcactgattcatgggtctgacgagtggcacgctcatggcgagcgtcgcggtgtgtacggcactgctgttcgccctcacggtatggctgtggccccggctggggcggcggggcgcccggcgggtgctggggcgcgtcgggctgctcgtgctcgtgcagttgatggtgctcgcgacggtcggggccgcggccaaccgcaccttcctcctctacgactcctgggccgacctcgccggtacgaagcgccaggccccggcggcgccgggcggcgccgccctggaggtcctgggccggcaggccccggaggtgcccggcggccggaacccgcgcgtgggcggcgtgatcgagaaggtgacgatccacggcgagcggtcccgggccgccgccgaggcgtacgtgtacctgccgccggagtacttcgacaagagcgacgagcagcgcaggttcccggccgccgtcgtcctcaccggctacccgggcatggccgagaacctcatcaagaagctgcactacccgaggctggcctggagcctggcgaagcagaagcgcatgcagccgatgatcctggtgatgatgcggcccaccatcgccgcgcccaacacccagtgcgtcgacgtccccgggggcccgcagagcgaggccttcttcggcgcggacgtcgtcaaggcggtctccggcgcgtaccgggtgggcgccgggccgcggagctgggggatcatcggcgattccaccgggggctactgcgccctgaagatggcggtgcagcacccggaggcgtacgcggtcggcgtgggcctgtcggcggaataccggcccgagatcgacaaggactccggcgatctgttcaaggggaacaaggacgaggagaagcggtccgacctgctgtggcacctggaccaccagccgcaggggaactcctcgttcctggtgacctcttcgttgcggggcgagcccaactacggggagacccaggagttcatccgcaaggtgaaggcgcccgcgcacgtctcgtcgatcatcctcgacagcggcggccacagcttcaacacctggctccgggagatcccgccggcgctcgtctggacaggagcacggctcggcgccgagtgagcggggggagtccggggcagggtccgggtgagccgcgtctcacctgaccgctgccgcttgtctatgcaacgagttgcatagaaagatcggggcatggcgctcgaccacgcgatcctcgtctccctgctggagaagccgggctccggctatgagctggcccgccggttcgaccggtccatcggctacttctggaccgccacccaccagcagatctaccgcgtgctggggcgtatggagggcaacgggctgctggccgtccgcgaggtcccgcaacagggccgaccggacaagaaggagtactccgtggccggccccggccgtgccgccctcgccgcgtggctgcacgagccgatcgaaccggagagcctccgccacgacctcgccgtcaagatccgcggcgcggccttcgacgacccggccgcgctgatccacgaggtcgaacggcacctgcgggcccacagtgaccggctgacccgttacctcgccggtgaactgcgcgacttcaccgggccggacgcccccgcaccgctcgacgccggtcaggagctccagcacgtcgtgctgcgcggcggcatcgcgttcgagcggatgacgatcgtctggctcgacgacgtcctcgccaccctccaccggctcgacgggcccccgccgacctccacggcctgaacctcgtcgtgccgcggcgcggcagccggaccgcccacggccccgcgccgccccccccacgcatgcgcccggcctcccctcccctcctccaacccctcggaaggtgaacctccatggcagacgccctgctcttcaacccgcacacctacgacccggcgcacttcgaccccgagacccgcaggctgctgcgcgccaccgtcgactggttcgagagccgcggcaagcgccgcctgatcgaggactaccgctcccgcgcctggctcgcggacttcctcgccttctccgcgaaggaaggcctcttcgcgaccttcctgaccccggccgccgcggccctcgacggggagaacgacaagcgctgggacaccgcgcggatcgcggccctgaacgagatcttcggcttctacggcctcgactactggtacgcctggcaggtcaccatcctcggcctcggcccggtctggcagagcgacaacgccgaagcccgcacccgcgccgcgcagctcctcaccgagggcgaggtcttcgccttcggcctgtccgagaagacccacggcgccgacatctactccaccgacatgctgctgcggccgtacgtcgacgaagccggtgcggccggcttccgcgcgagcggctccaagtactacatcggcaacggcaacgccgccggcctcgtctccgtcttcggccgccgcaccgacatcgagggccccgacggttacgtcttcttcgccgccgacagccgccacccggcgtaccacctggtgaagaacgtcgtcgactcctccaagtacgtcagcgagttccgcctcgacgactacccggtccgcgccgaggacgtcctgcacaccggccgggccgccttcgacgccgccctgaacaccgtcaacgtcggcaagttcaacctctgcaccgcctccatcggcatctgcgagcacgcgatgtacgaggccgtcacccacgcccacaaccgggtcctctacggccgccccgtcaccgccttcccgcacgtgcgccgggagctggccgacgcgtacgtccgcctggtcggcatgaagctcttcagcgaccgcgccgtcgactacttccgcaccgccggcccggacgaccgccgctacctgctcttcaacccgatgacgaagatgaaggtgaccacggagggcgagaaggtcatcgacctgatgtgggacgtcatcgccgccaagggcttcgagaaggacaactacttcgcgcaggcggccatcgagatccgcggactgcccaagctggagggcacggtccacgtcaacctcgccctgatcctcaagttcatgcgcaaccacctgctgaacccggccgagtacccggccgtaccgacccgtctcgacgcggccgacgacgccttcctcttccagcagggcccggcccggggcctcggttccgtgcagttccacgactggcggaccgcctacgacgcgtacgccgacgtggcgaacgtggcccggttccgcgaacaggccgacgccctctgcgcgttcgtggccaccgtcgcccccgacgaggagcagagccgggacctcgacttcctcctctccgtgggccagctgttcgcgctggtcgtgtacggacagctgatcctggagcaggcccgtctgacggacctggacgcgtccgtgctcgacgagctgttctccgtcctcgtgcgcgacttctccgggcacgcggtcgagctgtacgggaaggactccgcgacggcggcccagcaggagtgggcgctgggtgcggtccggcgcccggtcgtcgacgaggagcgtgcggcgcgcgtctgggcgcgggtcgaggcgctgtccggcacgtacgagatggccccgtagggacgcggtcccgggggaccggcccggaccggcccggaccggcctggcctggcctggccgggcccggccgcgccggccggtgccggtcccctctcaggcctgcgcggtgggccgtacgacgatgtcgcccacgtcgacaccgtccggctgctcgacggcgaaggcgatggcgcgtgccaccgcgtccggcgacagcgcggtctccatcatccggtcgatccgggcccgggcctgcgggtccatgcgctccgtgaagtccgtacggacggccccgggcgacacgacggtcacgcgcaggctgtccccggcctcctggcgcaggccctcggagatcgtgcgcacggcgttcttcgtacccgcgtacaccgactggagcggcacgacgcgcaggcccgcggtggacacgatgttgacgaagtgtccggagccctgctcgcggaagacggggagcgctgcggcgatcccgtagaggaagcccttgaggttgacgtcgatcatctcctcccagtcctcgacgcgcaggtcgtcgagcggggagatgagcccgaccccggcattgccgacgaggacgtcgagtctgccgtagcgctctcgcgcgaggtcgacgaggccgcacacgtccgcgcgccgtgtgacgtccgtacggatccaggcggctcggccgccggcccgctcgatccgggaggccagggcctccagccgttccgtgcggcgtgcgccgaggaccaccttggcgccccgctcggcgagcaggagggcggtggcctcgccgataccgctgccggcgccggtgacggccacgaccttgccttcgattcccggcatggcggaaatcccttcgggagaggaacggggacaggccgagggcatgccctaaagtgaaagtggaggcgccgccacttcagtcaccgtaagtggaggcacctccacttagcaagtggggagcagggagagccgctgatggccgcagacgcaggacgcccgctgagggccgacgcgcagcgcaaccgggacaagatcctggccgccgccgtgcgcgtgttcaccgagcaggggctggaggcgcacttcgagcgcatcgccagggaagcgggtgtgggcaccggcaccctctaccgcaacttccccacccgggaagccctgatcgaggcggcctaccggaacgaggtcgcccggctgtgcgactccgtccccgccctcctgggggccatgccgccctacgaggccctgcgcgcctggacgcggcgcttcatcgactacgccaccgccaagatgggcatggccgacgcgatgcgggcggtcctcgcggcggggagcgatccctacgccgacagccgcaggatgatccaggacgccctcacctccctcatggaggcctgtacggccgcgggtgcgatccgctccgacatcagctcgaccgacatgttcgccgccctcgccggtatcgccctgacctcggccggccccgagcagcgggcccaggcggagcgcctcctcgacctcaacctggacggactgcgcctgcgccgggagtgaccgggggcccgcgccgaccgggcgccggcgggccccctggcccctggagccccggcccgccgtcaggcgagagcgtccgccagcagcttcgccgttctggcgatcagcgtgttgtcccgcggcgccgtcggttccggcatggtcgagaggatggccaggatcaccggcggacgtccggggggccagccgatgccgacgttgttgttggtcccgtacgaaccggcgcccgtcttgtccgcgacggcccagtccttcggcagcccggcccgcagacggtccccgctggtggtgttcgacagcagccaccggttcagccgctcccggtccccggggtccagtgcgtcgccgagcgcgagccgggcgtacgtccgcccgatcgcgcgggggctggtcgtgtccgtcacccgcgacggctcggccgagttcaggtccggctcccaccggtcgagacgggtcgtacggtcccccagcgagcggcagaagcgggtgatcgcggtggggccgccgagctcgcgcagcagcaggttgcccgccgcgttgtcgctctgggcgatggcggccgagcagagctccgccacggtcaggccgcccgcgatgttctcgggccgcccggtgaccgacccgccgcccgcgtccgtgacgtcctggagcgtgtagtgaacgcgcttggcgagacgggtgccgtcgtggtcgaggtcgcgcagcacggcccccgccgcgagggtcttgaacagcgagcacatggggaaggcctcgtcggcccggtggaccacggtccggccggtggcggtgtcgcgcgcgtacacccccagccgcgccccgtactcgcgctccagcgcgcgaagccccgccacggcgcccttctcgccgtacccgggcgaagcggcgcgggccacacccacgggcagtgcggcggccagcgccacccccgccccggcggccagcagtgcgcgtcgggacgtcgatgtgtccggggtcgtcacgtcaggttctcctcttcctggccggtcgtgtttccccgaagacgtcaaacgtgatcaattcggttcccctcgcatcggcacccccgagggtgcactggtggtacaccccactcaggcccccggggcccggcgcgccctatcaggtgaaggcggccgccgtacgaggtgaccaccgcgccgcttttcggccgcgttcgtgggtaaggccgaatatcgttcataaccccggcaaaccacctgaagtgcaagatcaccgcttcgaggtaatgccaacggttttcaggctcaagtgggtgtacccgccgttactgttcccccggatctgtacggattcccggatattcgcccccctttttcctcgttccccggtgacgcgcgcgtccgcgccggtcgccacccttgcgaaggagagctcgcccgatgaccgttgacaccagcccggaagcgcagctggagccgccgcggcagtccagcctgagcacggcggctgcccgcaaccttgccagcacgaccaagtccgccccgcagatgcaggagatcacctcccgctggctgctgcggatgctcccctgggtggagaccaagggcggtacctaccgggtcaaccgccggctgacgtacaccgtgggcgacggcacgatcgagttcgtccaggacggcgcgaacgtccgggtgatcccgcgcgagctcggtgaactcgccctgctgcgcggcttcgacgacgacgaggtcctgaccgcgatcgccggccggtgcgtccagcgcgacttccgggccggtgaggtgatcgtcgagcgcggtgcccccgccgaccagatccacctgatcgcccacggccggatcagccagacctccgtcggcaagtacggcgacgacgtcgccgtcgccgtactcgccgacggcgaccggttcggcgagaacgccctgctggacgccgacgccacctgggactacacggccaccgccgagacccccggcatcctgctcaccctctcccgcggcgacttcgcctccgtgctctccgcggcaccgcaacttcaggaccacatcaaccggttcagctcgctcccgcagcagcgccagaaccggcacggtgaggccgagatcgcgatgtccgccggccacaccggtgaggcggacctgcccggcgcgttcgtcgactacgaactcaagccccgcgagtacgaactctccatcgcgcagaccgtcctgcggatccacaccagggtcgccgacctctacaacgggccgcacaaccagaccgaggaacagctcaggctcaccatcgaggcgctgcgcgagcgccaggagcacgagctgatcaacaaccgggacttcggtctgctccacaacgccgccttcaagcagcggatccagacccactccggcccgccgaccccggacgacctcgacgagctgctctgccgccgccgcggctccaagttcttcctcgcccacccccggacgatcgccgcgatcgggcgcgagttcaactcccgcgggctctacccggaccacgtcgacgtcggcgggcagcaggtcccggcctggcgcggggtcccgatcctgccgtgcaacaagatcccgatcagcaaggagaacaccagctcggtgctcgtcatgcgaacgggcgaggacaaccagggcgtcatcggtctgcgtcagaccggcctgccggaggagtacgagccgggtctgtccgtccgcttcatggggatcagcgagcaggcgatcatctcctacctggtcaccacctacttctccgccgccattctggtgcccgacgcgctcggagtgctggagaacgtgcagatcgcccgcaggcgggactaagaggacctgcccgacggccgtgacagccgggggacccgcccctgtcctggcccgccgagcacgcccgggatccgggacaacccacttacctctccaaggagttacggatgcccgatcctgggccttcccctctgcagtcgagtctgcccgcagccgtggtgtccttcggggcccacattctcgccaacgccctcgccgccgggcccgtcgagcccgctccgccgtccccgcccgcgccgtccggcctgccggcaggaccacccgtactgacacccgtgtccgcacccgcacccgtacccgacgcgggtgcgggtgcggccgcggcgccgcagccgggtgccgccctcgaacggatcctgcgcggccccagcggtctgggcacgacgagcctgcactgggcccggagtgaggagccggcggcggccgcggcgcccggcgcacccgccccggtcgcgggccgtccgatcccgggcctctaccaccacccggtcccggagcccgatccggtgcgggtggaggagctcagccgccggatcaaggcctgggcgctggacgaggtgtcgctctacccggaggactgggaggaccagttcgacggcttctccgtcggccgctacatggtcgcctgccatccggacgcccccagcatcgaccacctgatgctcgccacccggctgatggtcgccgagaacgcggtcgacgactgctactgcgaggaccacggcggctcgcccgtgggcctcggcggacgcctgctgctggcgcacaccgctctggaccccctccacacgacgaaggagtacgcgccggactgggaggcgtcgctcctgtcggacgcaccccggcgcgcctaccgctccgccatggagtacttcctccaggcgagcaccccctcgcaggccgaccggttccggcacgacatggcccggctgcacatgggctatctcgccgagggggcctgggcacagacggagtacgtccccgaggtgtgggagtacctggcgatgcgccagttcaacaacttccgcccctgtcccaccatcaccgacgccgtcggcggctacgaacttcccgcggacctccacgcgcagcccgccatgcaacgggtgatcgcgctggccggaaacgccaccaccatcgtcaacgacctgtactcctacaccaaggaactggccgctcccggacggcacatgaacctgccggtggtgatcgccgaacgtgagggctgctccgaccaggaggcgtatctgaaggccgtcgaggtccacaacgacctcatgcgcgacttcgaggccgcggccgccgacctggccgccacctgccccgtcccgagcgttcagcgcttcctgcgcggggtcgccgtatgggtcgacggcaaccactactggcaccagaccaacacctatcgctatagcctgcccgatttctggtaaagatgggaattgttcatgactagcaccgatctcaccgccgccgccggtacctcctccgtgttcatccccgccccggtgactccctatcagggggacatcgcccgttactgggaccgcgaggccaggcccgtgaacctgcgtctcggcgacgtcgacggcctttaccaccaccactacggcatcggtgacatcgaccacgccgccctcggcgacaccgaggacagcgcatacgagaagaagctgatcgccgagctccaccgcctggagtcggcccaggccgagctcctccttcatcacctcggccccatcggacacgaggacaccctcgtcgacgcgggctgcggccgcggcggttcgatggtcatggcccaccagcgcttcggatgcaaggtcgagggcgtcaccctgtcggccaagcaggccgacttcgccaaccggcgcgcccaggaactcggtatcgaggaccatgtccgggcccgggtctgcaacatgctcggcacgccgttcgagaccgggcaggccgcgggctcgtggaacaacgagtccagcatgtacgtcgacctgcacgacctcttcgcggagcactcgcgcgtcctcaaggtcggcggccggtacgtgaccatcaccggctgctggaacccgcgttacggccagccgtcgaagtgggtgtcccagatcaacgcgcacttcgagtgcaacatccactcgcgccgggagtacctgcgcgcgatggccgacaaccgtctcgtgccgcaggccgtcatcgacctcacgcccgacaccctgccgtactgggagctgcgtgccacgtcctccctggtcaccggcatcgaagaggcgttcatcgagtcctacaaggacggctccttccagtacgtcctgatcgcggccgaccgcgtctgacggcgtccggcggagcgccgaacgccgaccgaaggggccggggccgtcgtccgacggacccggccccttcggggtgcccccgggcaccggcgtacgcgcgggtcccggtcagtccacgagtaccccggggttgaggatgccccgggggtcgagtgcccccttcgcggcccgcagggcgagggcgaagggatcggggcgctggcggtcgtagcccgggcggtggtcccggccgacggcgtggtggtgcgtgatggtggcccggtgacggtgcaggacctcgctcgcgacggccttgaggtcgtcccagacggcgacctcgtcgcccggccggcccgccgccagcacggtgaagtagggcgccgcgccgtccggatacacgtgcgtcagacggcagttgacggtcgccggaaaaccggtggccttggccgcggcctcgcccacctccctgcgcacctcctcgatcaggccggggacgcggtcccaggtggccgccgtctcgaaggtctccgcgatcgcgcccatcctggccaggccgtcgcggaggtagggcatccgcaggaacgccgagcgccaggcgctcacggccgcgtcgccgtgcgggctctcctgggcaccgccgcccccggccgtcccgtcgtcccgtccgccgtgcgaacgggccagggcgacggcccgttcgagccggccggccaccggttcgtccgccgactcgaaccccaggaccagtacggaggcgccgtcgtgcgccgcgcccgacagcgcggcctcaccggagtccagcagacggcagttggcgggggagaggtcggactgcgccagggcgcgcaccgcgcggagggcgtcctggaagtccgggaaagcgaccgcggcggacgccttgtggcgggggcgctcctgcagacggacccatgcctcggtgatgacgccgagggccccttcggagcccaggaacagccggtcgggggaggggccggcccccgaggcgggaagccgccaggagctgctggtgccggccggggtcacgacgcgcagggactgcacgaagtcgtcgatgtgcgtgcggccggtggcgtagtggccgccggcccgggtggcgagccagccgcccagcgtggagaactcgaagctctgcgggaagtgccgcagggtgagtccgtggggccgcagctggtcctccaggctcggcccgagcgtgcccgcctggatgcgcgccgcgcggccctcggtgtcgacctccagtacgcggtccatggcggtcaggtccagggacatgacggcccggtgggcatcgccgcggtactcgacgcccccggagaccgaggagcccccgccgaaggggacgacggcgacctgccgctcgccggcccagtccagcagatcggccacgccccggtcgtccgtggggcgggccaccaggtcggggacgcggccggggcgtccgcgcagggcgcgcaccacgtcacggtaggccttgcccatggcgtgcgcggcccggtccccgggatcggtgctgaccaggtgggcgaggctccccgggggttcggcggcgggggcggcgatcgccaggtcgcggacgcggggaaccgggagcggacggtcgagggtgccggggagcagggcgcccatcgccgcgcactcggcgtcgtcgggatgcgcgtccgtccagccccagccccaccaggagcgggtgcgggaggtcggaggagtcggctgcggggtggtgccggccatggcggcgctccaggggtcgaggtaatttacctagcggtaaattacctactgataatatcggctcatggcaaccccttcctcgcatgcgtcgaaagccggaaccaagggagtcccgcgggagcaccgccgccggcagatgctggaagcggccacggaggagttcggcgcgcacggctacgcggccgcgtcgctccccgcgatcgccgcccgcgtgggtgtcaccaagacgctgctgcaccagtacttcggtaccaaggaagacctgtacgtggcctgtctggtcccggtcggggaccggctgctgggcaccatccgcgcggcgatgggcgagggtggggccgctccgcacacgccgctgcgcgtgctccacggcatcttcaccgccctggagggccggcgggaggcgtggttcgtgctgtacgacaccagcctgccgtccggaggcgaggccgcgcgccgggcctcggagtactgggcggccatcgaccggctcgccgcgggcggcaccgcggaactgctgcgcgaggccggatccaccgacccgctggacgccgacgcgctcaagtacgtctggcgggacctggtcgccaccctcgtccgctggtgggtcaagcacccggagcagactccggaggccatgacacggcgctgcgcccgcctcttcgcggccgccgccaccctcaccccggacgggcaccccgactgacagcgccgccggcgccgcgcgtggcgccgcgccgtcccggccggcggcgcgttgtcggtgcccaccgctacggtcggtccatgagagctactggaacgttcagcgtcgaagcgttcgtcccgaccgggctgaagccggagcctgccgtcaccaccgggctccccgtcggtgtcgcgaccatggagaagtcgttcgagggcgaggtggccggccgctccgcgaccctgttcaccgccgcgttcgaccaggagaccggcgtcggcacctatgtcgccatggagtccttcgagggctcactgaacggccgggacgggtccttcaacttcgtgcactcggcgaccacgtccggcagtgaccgcacggcggagttcttcaccatcgtgccctccagcggcaccggcgcactggcgggaatcgcgggtgccgggggcatggcggtcgatgcggacggcacccaccggatctggttcgactaccggctcggctgagtgtgccgcggggcagagccgcggcttcgaccggcccttcccggacgggggactacctggcgcgctcctgatcggcccgcgccgcctccgcggccttcgccgccttgagcttgcgccacacggtgcccagcgcctccaggtcccgctcgtccaggagctcggtgaagaccggggccagggcttcgcgccgggtggcgtccgcctcggcgaacaccgtacggcccgcctcggtgagggagacctccaccgaccgcgcgtcgcgcgccgagggcgtgcgggtcaccagaccccgggtctgcagggcgtccacgacgcgggagacctggctgcggctgagcagggtgctgttgccgagtacggacgcgggcaccggctcggggctggaggccagccacagcatgacctcgaaccaggacacggggaggtcatgggccttgaccagggcccggtcgacgcgatcggtcatgaccgtcccggcccacaccagcccgtagaaggcgtagtcggccgccggcatctcggcttcggtgagcttcttcggcatgtcggcagtctagagcttgcgtgcgcacgcacataattttatggtgtgtgtgcacgcacataaaccagccctctgaaaggccccgccatgtcgacctcctccacctccgcctccgaccgcaccgtcctgatcaccggcacctcctccggcatcggcctggccgccgcgatcgccgccgcccaggcgggctggcgtaccgtcgccaccctgcgtgacaccggccgggccgacgccctgcgcaaggccgccgtcgaggcgggcgtcgagctcgacatccgacagctcgacgtcgtcgacgaggcctccgtcgccgccgccgtcgagggcgtcatcgccgactacggccggctggacgccgtcgtcaacaacgccggtgccgggcacgtgggcaccctggaactcgaatccgtcgccgacgtacgcgaggtcatggaggtcaacttcttcggcgtactgaacgtctccaaggccgcgctgccgcacctgcgggccaccggcggccgcctgatcaccgtcaccagcgtcggcggcgtcgtcggccagcccttcaacgaggcctactgcgcggcgaagttcgcggtggaggggtacatggagagcctggcccccgtcgcgggcgccgtcggcgtgagcgtgaccgtcatcgagcccggcgccgtggcgaccgagttcgtgaacaacatcggcctcgacctcgaggcccggatcgccgcggccggcccgtactccgacgcgctgcgccactacgtcgagcgcacggtcggccagttcctgaacggcgcgcagaccccggccggcgcggccgagtccgtcatggaggcgctcaccgccgaccggcccgccttccgcatccagacctcgcagtgggcccgtgacttcacggggaccaagctggccgaccaggacggctcggcggtcgtcggtatgaccgggacctgggtcgcctgacctgcctcgggcgtcccgggcgggaggggggcggggtcccgaactgtgctccgcccggaaccgggtcatgatggccggaggtggacgaggccgtcgcgccgtccccgggaccgcgcgacggcccgcccgggtcgggaggtgactcgtaggcatggacgaatcgcgcagggcctggttcacgatcggcgtcgtcgtcgccgtcatcctcctggacctcctggccatcatcctgatgaacacactcggctgagcccggtcccggtcagccgtacatcgccaggcggtacagggccgcgagcgcgccgtcgacgggatggggctgcggtacgccggcggagtcgagcctgttccaccgctgcaggttcaccgcgaccgccatctgccgcttgccgtcggcacgggtcatggccagtgccccgccaccccagaccgtgccgccatggccccagaagacgccctgaccgggaccgggaccctccatcgggtgcagaccgaggccgtactcgatcgtcctgccctcctgggagacgaccgggaccgtgcgctgcatctgcgccagcgacgacgggccgacgatctccccggccagcagtgcggcgtagaagcggttgaggtccgcgacggtcgatatcagcgaggccgacggccccacccatgacatgtcgtagacgctgtagtcgcgcggcgggtcgatcatgccgaaccacgcctcgtagagctgcgagtgcggcccgtcgacgtacggtccggcggggagttcggtgtccaggagcccggcgcgctcgatgacgttccgggtgatgtactgctcggccgtggtgccggtcacctgttccaggagctggacgaggagcaggtaattggtgttggagtacacccccggccgtccgcccgggatgccgacggcaggtgcggtgacccccgtcctgatcagttcggcagggtcgaaccgcgtgaaccggtggtcgtccaggctctgcggcccggtgtccgcgagggaggggaacgccttgagggaggggtaggcgtacgggaggtactcggcgaggccgctggtgtggttgagcagcatccggaccgtgatcgccgcaccgcgttccccggggaccagtcccggaaggtagcggccgatcggtgtgtcgaggccgatccggccgctctcggcctgctgcaggaccgcggcggcggtgaaggtcttggtgatgctgccgacgcggtgccgcatgtcggcggtgacggggcgaccggtggcgacatcggcgacccccgcggcgccgcgccagacctgctcgccgtcacgcacctcggcgaacaggccgggcatcccggcgcggtggacgttttcgatggccgcgtccagcgccgcgccatccagtgggttcttcacgtcatgcgtcctttcgtgttccccgggggcgagcaccgcatcgctcgcccgacccggaccagcagggcacgagtggcgggccgtcgcgaccgacacgcctatgtcctcattatgcacgcggtgcgtgcaacaccaagtgcacaggtaggatgcgatccggtgagaggagcaagatggcaggccgaaggcgttggtcgaccgaagagatcctggatgcggcggcggagctgctgcgcacgagcgacacggattcgttcagcgtgcgcaagctggccgcggccctcgggaccgattcctccagcctctaccgtcatttccgcagcaagaccgaactgctgcgcgccgtcgccgaccggatcctcctggccgcgatggacggctaccgccccgagggcgactggaagcagcgcatcacggccctggccctgcgtgcgagagaggccttcgggcagcagccccaactcgccgcggtctgggggcgctatgcgtcgagcggcaccggttcgcggctggtcatggaagaggtgctgcaggccctgcgcgcgtcgggactgcccgacgaggagatcccggcgcgctaccaccggctcgcggtcctccttgccgcgctgatcgcctccgaggccggggtcagcaccgtcaccccggcagagcatgagcagggcatggagctgttccgcgtggcggttctgggcgccgaccccgaacgcttcccggccctggcccacttcgcccgcgacgtccgccccctcggggaggatcgccgcgccgcgttcgaagagatcctcgccgcccagctcgccgacatcgaagccgcggttcgcccggcctaggcctccggcctacctctgacaatccgtcaatttccttgtgtacgcggccttttccggctcttcggtacgcaaggaacggagtctgcgcggccccttgccgtgtcgccccggttcgcgaatgatgctcgcggcgcgccggtcgacggtgttccgtcgccccgcgtccgccatcctcgcacccggccggccaggaggcccgttttgcggacgaaccgtcacatccggagatcgatggtcgtcgtcggtgccgccctcgcggtggtcgtcgccgttccccaggtggccttcgcggccccgccgccggcactccccggcaaggcggaagcgatcgagctgacctatcagcccgcctacgactacgacaccgacggctgctacccgacgcccgccatcagttcgaccggcgtcctgaacggcggactcaaacccaccggcgccctcagcggcaactgccgggacgcctcggacctcgccaacaccaacggctactcccgctggaagtgcaacaacggctggtgcgccgtcatctacgcgctgtacttcgagaaggaccaggccctgcccggcatcgagctcggcggccaccgccacgactgggagcacgtggtcgtgtggatccagggcaacgacgccaagtacgtcgcgacgtccgcacacggggacttcaacatccacacgcgtgaccagattcgctgggacggcaaccaccccaagatcgtctaccacaaggacggcatcggcacgcattgcttccgcgcggcgaacaccaacgacgagccgcccgagaaccaccgcggcacctggcagttccccacgctcgtggggtggtcgggctacccggcgaccgtgcgcgacaagctcacccaggctgatttcggcagcgcgcacttcggcctgaaggacgactccttcgcctcccacctggcggaggccaagcctgccgggatccccttcgacccgtaccagtagcacccggcacccggcacccggcacgccccgggcaccggccccgcaccgagcgggaccggtgcccggggcgccgtggcgtcagcccgcccagatccggcggtacccctcgcggtagccggacgggtcccaggaggtggcgccgtcgctgttgccggcggtggcgacgtgcacgggggccacgtacccgctgggcggccggccggcgaaggcgcggttgaactcgtcgacgatctgccagccctgctggttcagcggctcgggcacggtggcggcctggaactgcctgctgttgatccgctggaaggcggacgggtcgccgtcgcccgcgccgatgttgaagggcggcccggagcccggcttgcccgccgcgcgcagggccggggccgcgtccgcgaagtagaggtcgttgatggcggcggagtacgtccagtcgtcctggaagcgggagagcagcgaggagaccgcctgcggggtgcggctcgcggcgtccgggatcgggatgttctcgtagctgaggatccgtacgccggaacaggcggcgagccccgcgcggatcagctcggccttgttcttggcgaaggggatcgagtcgtcggtgaagaggacgactccggcgtcacccgcggaccgggtgatgatccagtccgcgctgatcctcgccacgtcctccaccttggtggtgacgttggtgaacagcttgggccgctcgctcgggccgggggagcccaccgcgtgccagccgatcaccgggatgtgcgccgcttcggcccgcgccatctgctgcgaggtcagctgggggtcgaagccgccgatgacgatgcccgacggccgcacggtgatggcctggctgagggccgcctggatgccggccggggtgccgtccccgtcgatcacccggacctgccagccgatggccttcgccgcctcctccagccccttcgcgacgcccgcgacaccggggttggtcatggtctgggcgacgtagacgatcgacttgcccggtacggccgcggggccggtggtgggaccgtgccaggcggtgtcggagttctcggcccgcgcgacggcagcccgggcgctcgcgagcgcggtggggcagcccgccttgggcggcgcggcgccggtggaggggccaccgcccccgcagccggcgacgagggcgacgaccgctgtcagcagggccgcggccgtgcgcgcggtcctgcggtgcgggcgagggtgcgagtacgggtacgagtacgggtccttcgggtacacggtgctcctgacgcggtgcgcgtacgaactcttccagggggtgtcttgtcgatcagggtggatcagggagcggtggtcggtgccgtgtatcgcaaggcggacgagggaggcgacgcggagcgtcgccgaccgaggacaacgcggcgaggcgcggtgccgggcgccgcgagcccgccctgatcgacaagacaccccctaggggctgcgcagccggcggcgggcggagtagccggccaggccgacggcgatgaggagggtggcgccgttgaacagcggagtggcccagaagtcggcgccgagctggccgatgccggcgaggccgatggcgaggacggccacggccacgacggtgccgagggcgttgacgcggccgggtttgatcgtcgtggacccgagcagcgcgccgacgaaggcgggcagcaggtagtccagcccgacgctcgggttcccggtctgctgctgggcggcgaggagtaccccggcgatgccgacgaccagccccgatccggcgaaggcgcagacggagtaccggtggctggggatgccgatgatgtcggcggtgcgccggctggagccgatcacgtacatgtaccggccgagcggcagccgttccaggaccacccagagcgcggccgcgagggccaggacgtagtaggcgggcagcggcaggccgaggaaccgggagttgtacaggccggtgaaggcggcgggcaggccgtccgggccggggacgatccgggagccgtcggtgatccagccggtgacggcgtacatcatgctgccggtgccgagcgtggcgatgaaggagtcgatgcgcacgtactcgacgatgacgccgttgaggatgccgaccagtgtccctccgatgaccacggtgaggcaggcgagcggccagggccagcccgtgtcgacgatgagctgcatcaccatcacatgggccaggccgaggccgtagcccatggacaggtcgaacttgccggtggcgatggggatggtcgcgccgagggccaggatggcggggatcgactggttggagaggatcgaggagacgttgtcccgggtggggaaggtgtccggcaggacgagggagaagacgaggaacagcagcacggcgagcgccagcaggccgtaggcgccgatgtggtgaccccgcaggcggttcagcggggaccgcggccgaggcggagtgggaggcgcgggcgggggtgggggcgcaggcgtggggggaagggtcatcggtccgccgtggggccggtgatcgcgggcatggccgaggcggtccgggtgagttcggtgaccgtgagggccgcaccgctcagctcggtgctcacgctcccgcgcacgaacaccagggcgcgatggcacacgtccgcgacctcctcgaaatcggtggagatgagcaggaccgccaggcccgaggccagggcgtcgtcgagcagccggtggatggtggccttggccccgacgtccaccccggcggtcggctcctccaggacgagcaggcgcagccgtccccggagcgagcggccgaccatgaccttctgctggttgccgccggacagggtggcgatcggcacctcgctgtcgcgggggtgcaccgagaaccggtcgatgagggcggtggcctgggcgcgctcgcggcgggggccgatccagcgcaccgcgggggcgccggccgcgcgcgggttcgccaggaagttctcccgtacggtcagatccgcggcgcagccctcctcctgacggttggccgccacgaagccgacgccggagtcgagagcggcgtggaccgtacgcgggtggtacggccggccgtcgagcaggacccgcccgccgaggaccggcagggcgccggcgagggcgcggcccagctccatgtggccggcgccggtcaggcccaccatgccgaggacctcaccggcccgcaggtccaggctgacttcgccggtggacacggtccgcaccctgtcgaggctcagcacgggcgggccggcggcggggggaggccccggcgtccgtgcggccggtgcgtggcccacgatcgcgcgcaccagccggtccgggctgtgaccggcgagcgggccccggtcgaccagccggccgtcgcgcaggacggcgaaggtgtcggcgacctggtagacctcgtccagccggtggctgacgtagaggatcgcgtggccgcggtcgcgcagggtgtggagtacgccgaacagccgcgcgcagtccgcggcggggagggtggcggtcggctcgtccagcacgatgagctcggcccgggtggcgagggcgcgggcgatggccacgagcgagcgctcggcgggcccgaggcgggcgatccgggcgtcggcgtccagatgcccggcgacgatctgcagggcctcgtcgcagcgctcccgggtccgccgccaggagatcagcccgtggcggcgggggtatccggcgcccagggcgatgttctcggccaccgtcatccaggggacgagcccgaggtcctggtggatgaaggacatgttccgggtcgcggcgtggctgccgaggggatggccggtcacggtgaccgcgcccgcgtcggcgtggtggacaccggcgagcagcttgatgagggtggactttccggctccgttggggccgagtagggcgaggacgctgccgcggtggatgtcgaggtcgaccgcgtccagcgccagggtgccgccgaaccgtttgctcaggccgcgcatgcggacgagcggtgcggcaccggaatgcgagggtgggctcgcccaggtgtcgggagcgtcatgcacagacttctccgggggtcggcctccgagttcttcccgacggtacggggcactctacggtgacataggggctcattcccggcatatcgccgcactgtttgaccccaatggccgaacggccggggattcgggggtcatgtcgcggccaggctgcactcggcccagatgaccttgccgccggtggtgtagcgggtgccccaggactgggcgagctgcgcgacgaggaacaggccgcggccgccctcgtcggtggtcgccgactggcgcatgcgcggggcgctgctgctggcgtcgtgcacctcgcagatcaggttgcggtcgtggatgagacggacccggatgggcgcggtcccgtaccggacggcgttcgtgaccagctcgctgagcaggagttccgtggcgaacgcggactcctccagcccccaccggttcagctggctcacggaagcggcgcggacctcggagacgagcgccggatcggcggccagctcccaggtggcgatccggtccgcgggtacggcgtgggtgcgggcgacgaggagcgcgatgtcgtcgtcggggtgctcgggcgccacggcgtcgaggacggcctggcaggtttcctccggggtccggtccgggtgggccagcgcccggttcagggcgtcgagggccacgtcgacgtcgcggtggcggtcctcgatgagcccgtcggtgtagaggacgagctggctgtgctcggggagccggatctcggccgactcgaagggcaggccgccgaggccgagcgggggaccggcgggcaggtcgaggagggatacggtgccgtcgggtcggaccagcgcgggcggagggtggccggcgcgggccatcgtgcactgctgggaggtggggtcgtagatcgcgtacaggcaggtggcgccgacgatgccggtgctgcccgagccgggaccgtccccgccctcctcccggtcgaggcgcaccatcaggttgtccaggtgggtgaggagctcgtcgggggccagctccagctcggcgaagttgcgggcggcggtgcgcagtcggcccatggtggcggcggcgtgcagtccgtggccgacgacatcgccgacgaggagggcgacccgggccccggacagggggatgacgtcgaaccagtcgccgccgacgcccgactcggcgggcaggtagcggtgggcgacctcgacggcgctctgctcggggaggtcgcgggggagcaggctgcgctgcagggacagggcgagggtgtgttcgcgggtgtagcggcgggcgttgtcgatgcacagggaggcgcgggcggcgagttcctgggccagcgagcggtcgtcgtccccgtagggggccgggtcctgcgagcggtagaagctcgcgacgccgaggacggcaccgcgggcgagcagggggaccgtgatgagggagtggatgttgtgggcgaggagccgttcggcgtgccgggggtcctgggcgatccagccgaaggcggcccgcagatcctgttcgagcaccggctgcccggtggctatgcagcgcatgtggggcgtggtgggccgcagactgatctgcgcgccgaccgggtagaaggggcagtcctcgcggatgccgtggaccaccgtgcgctgcatctcggtggtgggatggggggactcctccccgagcagtacggccgccggcaggtcgatggtgacgaaatcggccaacctcgggacggccgtctcggcgagctcccaggcggtgcggctcacgtccagcgtggtgccgatgcggttgctggcctcggccagcagctccaggcgccggcgtgccgcgacggcgtacttgcccacctcgggctcgccgaccagcaccagccccctgacccggccctgggcggggccggcggcggacgccgcgacggcctccccggcggggcctccggcgcccggtgcgccgcctgcgcggaccgtcgccggttccggaccgggggtgacgtgaggacggaacgcgggcggcaccccggcgggggcgtgcggctgggggtgggtgggggcgggggcgtgccgctccgaatcctcggggagcagggcctcgacgacgaccccctccaccccggcggcgctcgtcacggggcggctgaccagcgtgacccaccggccgcgggacaggggcacttcggcggcggcccgccggtccccggacatcagctccgtggccttctccttcagggtcgcctggtcgctctgctccagctcgctctggaggaagtcggccatcgccaccgggtgcccgtcgaggccgtgctcgccgctcacggccaggctcgcggtgtggagataggcctgcagcaggccgtgctcgcgcgccgaactctggtccatcagccgtcgttcgatggcctcggccgccttgcgcaccacggggatcagcgccgggtccgcgtcggtgtaggggtatccgaggcacaggacgccctggatgtgcccgctgagctggtcgcgcagggggatcgcggtgcaggcgctcgactgggagcgctcggcgaagtgctcggcgccgtagacctggcacaggcgcctctccgcgagggtgaggccgatgccgttcgtaccggccacctgctcggcgaagacgaacccggggaggatctggatcggggcgagctccttgagcatggatttctcgccgaagcggcgggcgaggaccatgccgtgaccgtcggcgaggcagatgttggtgcggctgcccgcgaagatgctctggagccggtcgagtacgggctcggcggcgcgcagcagcggaccgtccgggtcgcagccctcctggtacgggagctcggactgctccggcgacagccccagcagccgactgcgctgccacgagctcaggatcggacttctcacacttccctcgaccgactcgccctgcaggaatcggtcacggaatcgcacggggccgatgcggtctccgacgacccccatgtgcatcacttcccctcaccggagcaccctcgatcgccagatttgagtatattcctcccatttcggcaatgaggtctgggagcgaagcgatcagcgggtgcccgcgtcacaggaccgcgaccggattgacgggcgagcccgtgccgccggggacgttcagcggtgccacgacgagcaggaacgtgtagcggcccgcctcggcgcacgccgccgagagcggttcgaggtcgaggttgtccagcagcggcacccccatcgccgtgacggcgagcgcgtggacgggggagtgcaccccctcgaccggcgaaggccgtacgtcgctgtccccgtcgccgcccagcagtgcgacggcgcgctcggccagcatcggcagggcgtccacgtgccagcccgcactcgccgtgtcggggttccaggggccgagctcccggcgccggcgcaaggccccggagcgcagcagtaccgcgtcgccgtccccgatggtcacgccgagcgcctcctgcgcggcgacgacgtcccgcgcgtgcaccgcacgacccggttccagccaatcgaccccgaggacggcgggcaggtcgaccaggacgccccgtgtgaccagggggcccagcgccgacaccgcgccgaagcgggcacccgccgcgtcgacggactcccgcgccgcgcgcccgtcgtacagctgccctcggtaggcgatgtgtgacagcgcgtcgaggtgggtcacgctcttgccgtggtagtcggcggccaggaagtccttgtggacggacggttccggggcctgtacgtcgccgaggtcggacatgtagtgcagggcgggcttcgcgttgtccgggccggggcgggtgtcccagggccgtgccatcgggaccaccgtcccgtccctgaccgcggcggcggccctgcgcgcatggtcggccgtcaccccgttccaggccccgcggtcggcctcggcccaccggccccacgtacggaccgaagcgaacagtgcgtcgaactcctggcgcgagacggcgggcccgttgtccggccggccggcgggggcaccgcctcgggcgccgccggcggtgccggccggggcgtcgccggggttgccgctcatgaccccagtgtccggcggttcacgctcccgcgctggccgggagacgttctcggcggaagggggcgccgttcgctcgcgctagtgtgcgcacgtgagcttccaagtcgtcattggtttcgggcccgccggcgccgccaccgcccggctcctcgccgaacagggccataccgtaagggtcgtcaccagatcgggccggagcccggaacccgggatcgagcacgtcgcgctcgacgcgacggacaccgatcggctgtccggggccgcgcggggcgcggcggcgatccacaactgcgccgcgccgccctaccaccgctgggcggacgactggcccgcgctgtcctcgtccctctgcgccgcggccgaggcgaccggggccgtcctcgtcatgctgggaaacctctacggctacggcccggtggacggccccatgaccgaggaactgccgctcgcggcgaccggccccaaggggcgggtacgcgccgaggtgtgggagcgggcgcgggaactgcacgggcagggccggatcagggcggtggaggtacgcgcctcggacttcttcggacccggcgtcaccgacggcggtcacctggccgcacgggtcgtgccgccgctgctgcgcggcaagccggtcaccaccctgggggaccccgacgctccgcacagctggacctaccttcccgatgtcgcccggacgctgtgcgcggccgcgcaggacgagcgggcctggggacgcgcctggcacgtcccgacccagcccccgctgtccgtacgggagatggtggggcgactgtgcgcgcgggccgggacggggccggtcgccgtacggcggctcccgtcggccgtgatcggcgtggcctcgctcttctccccgctgatccgcgaactgaaggagatccgctaccagttcgaccgcccgttcgtcgtggattcgagtgcctgcgaggtcgcgctcgcggtacggtccacccccgtcgacgagcaggtcgaggcgaccgtggaatggtggcgcgcacggctcgcggccgacggctgacacggctgacacggctgacaggacgggatgaccacatggaggactccaggaggccgcggcgagaaggcatcgccgtcgtggggatggcgtgccggttcccgggagcgcgcgatgtgaaccagtactggaggctcctgacggccccgaaggcacagttcggggcgatcccggacgcgcggtggcgcaccgcggccttcaggggcgacaacctccgtgacacctcttccgcgtacaccgacaccatggcgctgctgccggaaacgggccacttcgacgcggcccactacggcatcccgccgcgccgggcccgcgcgatggatccgcaggccaggctgctgatcgatctcgcccgcgaggccatccaggacgcggggtgggaggccgacggcttcgaccgcgaggagacctcggtgatcacggcgctcaccgagggcggctaccgcgaactcagcaccctgcagatccggatgcgccagctggccggtggcgagttcggggcgcggcacacccacccgcacctggcggcatcggtacgcgccgtcgacgggctcaacggcacctccgtggccgggctcctgctcaacatgggcccgaacagcatcagttcggtcttcgacctgcacggcgagagttacgccctggactcggcgtgctcgggcggactcatggccgtggccaacgcggtgcacgcgctgcgcgcgggccgctcccgcatagccctggccggcggcgcccaactcgtactcacccccgacctgctggtggggctgtgccggatcggcgccctctcgcgcagcggccgctgcctgcccttcggcgcgcaggccgacgggttcgtcctcggcgagggcgccggggtcctggtgctgcggcccctgaccgacgccctggcggcgggcgaccgggtctacgcggtgatccgcggcgtgggaacggccaacgacgggaccgtgcagggcggcctgcacccccaggcggccggtcagctccgcacgctgcgccgggcctaccgcgacgcgggcctggccccggacgcggtgggctatctggaggcgcacggcaccgggaccaccgtcggcgaccccgtcgagctcggtgtcctgcgcgaactgcgcggtgagcacgccgaaccggcctacctcggcgccgtgaaggcggtggtcggacactcgctgaactccgccgggatcgccgggctcgtcaagtcggtcctggccgtgcagaggggcgtgatacccccgcagccggagtgcgacctggccgaccgctccggattcgacgccgcccggctcacggtggccacggaggcgattccgtggccggagcgcggaggtccgcgccgggcgggggtgagcgccttcggcttcggcggcaccggtgtccacctggtgctggaggagtgcaccacggccccggccggcccggcggcgtccgcggcgccggacgacggaccgcacgtactggccctcagcgcgcgcgaccgtgacggactggcccgctacgcccgggagctcgcggacaccatcgccggagaccggctcccggccgccgcggtggcggccaccctcgcccgccgcgcacccctcacgcagtgcctcaccctggtggcccgggacggagccgacgccgtcgcccggctcacggcggcggccgccgccctcgcggcgggccgtacggagggactcaccgagcacacggccgcagccgccgtgccacggccgcccacggcggtgcggacacccccgtgcaccctgcccccgagcccgctggccccgcgccgccactgggtcgtggacgatgcggcgcgcgaggtcccggatcccgccgggacgatccccgaggcacccgccgcaccggccgtgtccgccgtcccggccgcatccgtcgtgtccctcgtgcgtgaagaggtcgcgcggaccggtgtcttcccgccctccgagctgagcgaacacctgacgctggtggccgacctcggattcgactccctgatgctgcaggagctcggagtccgcatcgcccagcgcataccgggcttccggtccgaggagctgttctcgcccggactcaccatcggccggctgatcggactcgtccacccgggcacggatccgggcacggatcccgcttccgcttccgcttccgcttccgctcccgctcccgccgaaccggccctccggcaggagggcgccgcatgggccgccgggacggccgtcatcgacgagttccccgaggtgggcgagttcgagcagcgcctcggccggatcggcgacagcggcgcggccaacccctacttccgggtccacgagggcaacatccgcgacacgaccgtcatcggcgggcggtccctgttgtccttcggcagctacaactacctcggcttctccggtcatccggcggtcgacgaagccgtgcaccgggcggtggagcggtacggcacctccgtctccgcgagccgcgtgctctccggcgaacgggagctgaccgtaaggctggagcgggcgctggccgacttcctcggagtcgacgactgcctgaccctggtgagcggccacgccaccaacgtcaccgcgatcgggcacctcgtcggtcccgaggacctcgtgctgcacgacgcgctcgcccacgacagcatcctccagggctgtgccctgtccggggcggcgcgacgccccttcgcccacaacgacatggggcggctggagcacatgctgcggctcaacaggtcccggttccggcgggtgctgatcgccgtcgagggcgcctacagcatggacggcgacctcgtcgacctgcccgccctggtcgagctgaagaagcgctacggcgccctgctcctggtcgacgaggcccacagcatcggcaccgtcggcgaacacggccgcggagtgggcgagttgtacggcgtcgaccggtccgaggtggacctgtggatgggcaccctctcgaaggccctcgccagctgcggcggttacctcgccggctcggccagaacggtgcgctggctgcgccacacgctccccggcttcgtctacagcgtcggcctgactcccgccaacgcggccgccgcgctggccgccaccgaactgctcgccgcgcagccgcagcgggtgcgcgcgctcaggcggaactccgggctcttcctccggctcgccaccgcggcgggtctggcgacgggctccagcggcggcacacccatcgtgccgtgcatcctcggcgattccgtgaggaccctgcgcgtcgcggaccggctgttcgcccggggcgtcgtcgcggacccgatcttccaccccgccgtggaggagggactgtcgagactgcggttcttcgtcaccagcgagcaccacgaggacgacatcggacgggccgtgtcgatcctcgccgaagaggtggccgcccgctgagtggtccatctcagatcagggtgcgttcgatgcggctgagtgtggcgctcctggcggaattgccgtcctcgtcgtcccccgcgcccggcgccccggcgggccgccgcccggcgtcgccgatccgctgggagaggaggtaggcgatgatctccgcctcctgctcctggacgtcgtcgtaggtcgcgcgcaggagcatgtcgcggacgagttcggggtcgaggttggggaagaggaggcgtgcggccgccccgtccagcccgcctgccccgcgatggcagcagatgatgtggccgagctcgtgcaagatgatgtgctcctgatgagcgccggtggtgttggcgtcgtagaagatgaggtcctcgtcgcgcgcggcgacccacatgccgcacggatgcgaggagggcatctgcatcgggaccaggatgatcgggcggtcgcgtacctccccgaggtggcggcacagctcggccacgtcggtcgccctcggcagatcgagttccgcgatccgctgcgctccggccttgcggagcttcttgagccggctgcggcggtcgtggtcggcggaccgctccttgcgggcgcccctcatcccggctcggaggggtcggcgacgggcggcaggccctgcatctgccggtactggtccatgatggccgtgatggcctggaggttctccttcttcatcccggccgcccgcatcgccacggcgcgcaccccggactggcgcagcgcctcgatggcggcgagctcgccgagcacggactcggcgaccttgtcgtcgaagaagtaggcgaccgagacgccgaagaaacgggccagggcggacaggagatcgggtgacgggttggagcgcttccccgtgcgcagctgcgacaggtacacgcccccgaccttgagttcgggggtgacccgcttcagctcgtccgcgacctcggcgttggtccagtgcctgcccttggggcggaccgttctgaacaggtcgtcgaggcgcaccgcgagcagggggcgttcctcactcccgttcccggtgtcgtgctcggtcccggtcatggtgaaccatcctcccgtcgcctcctccgtatagctctcagctatacgtcagtttcacagattagctgtcagttgacaattggccaggactcggcgaacgtggggtccggccggatagctggcagctaacttgcgttcacgggggacgcacatttggtcgccggtgacatcggactggcccggccctcgggggatgggccgggccagtccgggcgggagccacccgtccggccgccaagcagcggggaaacgggatacccgcccggtttgacgggggatgcaaaccgggcgggagttctcaactcgccttgccgagcttactgtaggcggctgccacttgggtgagccatgccagctctgccgcgaagttgttcgtgtcccggtcgtcgaagtcaccctcgtctttgttgttccgggggaccgtcccggtcagttttgcctgcaaggcccgcttgatctgtgtggcttcggtgaaggcctgccgcgattccgcgctcacctccttggccggatcgcacccctcgccggtgctccggtcgatgtacggacgcaagtcccgccacccgtcgcgtatttcgacgacccggcggtgcagccggtagccgaggtcggacaccgaggcgccgggcggctccagggcgatgtccggggaggactcgtacaggtcccgccagagcgggtagagcgcccggtacgaccggtaggtacgggcccactccaggagccggctcgccgccgggccccaggaggagttggtcaggctgagcgagagcatgacgatgcccgcggcgctgaacaccgaagccgccaccttccaggccccgatgtcgaccccgccggccgccgtgaggatgttgaccgtcctggccgcgcagtagaggaacaggaccacggcggtgaccgagagcagccgcagggcctggcgcagcgaggcgttgtcggtcatccgggcgtacggcccgcactggaggtagatcgtgacgcacgggatcgcctgggagacgatgaaggccaggaggtacgtgagcagcagcggctcgctggtgccgtcgaagtccgacgccggccgggcggtgccgtcggcgaggaggaagagggccgtcagcagcacatcgagagcgatgccggtgaccacccagtagcgggtcctgcggacggaccgctcgtccgccgcggcccaccgcagcaggatgatctgcgcgctgacgcagaaggcgaccgccgacaggtgcatgagcaggacggcgaggttgccgacccccagcaggggcccgccccccatggccagggcgcccatcgtgaaggtgaggcactggagcagcagcgtggcgatcagcgtgcggtacgcgccgtccttccagctgcgccgcgcctggcacagccggtagacgagcgccgcgtacgacgagagcgcggctatgacgaagcaaagggtcctggtggtgttcacgtcctggatttctgccggtgtcgcgtgggtcgcgcgcggggcggatgggtcggtcgggtcagccggtctgcccggccagggggaccacgaggccgatgctctcggcggacacggcgacggcgtagtcgaagaacgcggcctcgtcccggacactgtcgtgggtacggctgaagacctggaacaccaggaggccgatcagaccgctccacaggaccatgccgcgctcgacgacgtcctcgaacggagccccgggcgcaccgccgaagagctgcacggcctccggcagcagcagcggcggaccgggcaccgaccgccggggcggggtgagttcaccggcctccagcgcggagcgcacgatgccggcgagaaccgcgggggtgcgcgaggccgccgggaccgtgtcctgcggggcgtcgtagccgggcacgggtgagccgtagatcagggtgaactcggcggggttctcgaaggaccaccgccgcagcgcgcgggtgacggcgaggagccgggcgcccccggacgcgccgccctccgcggcggcccggtgggcctgctccatcgccgcgccggacgcgtcgtaggcgtcgatgaccagtgcggtcagcagatcgtcgcggtgcgggaagacggcttcgacatcggcggcgggaaggccgccgtcgcggaccaccgcatccagggacagtccggcggcgccccgcttcaccagctgctgacgggcgatgtccttgatcaccgccgccggggtgatgtcgtcgtcctcggtcgaactgattgcggaaacatccatgccggaaccgtacccgccgccaactggggccgtgcgtacggttggtcgaacgcctcggtcgtgcgccgggatccggccaccgggcgggtacggaacgttccgggcgaatgcggtcgagcggtggacgtcaggcgtcggacagggtgctgggtccgccggacagggcgacgtgcagaccgtcgggccggacctccgcggaggtggcggcgagcccgagcgggtactccttcggcacgcccgcctgcgggccgaagccgccggcgccgatcccgagccggtcggtggggaccgggcggccgaacagggtgagcccgttcacggcgagggtgaccttgccgtccgcgagtaccggacgcagcgtcagccgcccgagaccgcccgggccgacgtccgcgaggaccgtccccttcgccgggtcggtggtgaccgcggccaccgccacagacggtacggcgccgcggatcgcggcggcgagggactgcgtggagaccgtcacgtccacgtgggaggcggcgaccgtggtcgtcccgccgaggcggacgtcgtccagccgggcccggacgcggacctgggagagccgcccgacccgggcgtcgtcgctgctgacgtcgagccgggggatgctcccgtgcgccaggtcccacagggcccagccgtcggcgacaccgaccgacacgtcgtcgccgagacccggggccgccttcgcgacacggctctggatgcggtggcggaccgtgtactcggccgtgcccgtggccacgacggccagcaggaccacggtgaccgtgaccgtgaggacgagacggcggcgcagggcggcccaggtcctcctcaaggggtgcttcatcggaggtctcctcgggcgggcgccagaccgggctcggtaccggtctccggcgcgggatccgatccggcggcgggctcgggcccggcggcgggcccctcggggtcgagatgaggaaggaagcggtccagccagccggggagccaccagttggcgcgcccgaggaggtacatggacgcgggcaccagcagcaggcgcaccacggtggcgtcgatgacgacgctgacgccgaggcccagcgcgagcatcttgacggcgacgttggtggagagcaggaacgccaggaacacgctggtcatgatcagcgccgcgcaggtgatgacgcgggcggtggcggcgagtccggtggcgacggccaggtggttgtccccgtaccgcagccaggtctcgcggatccgggagagcaggaagacctcgtagtccatggagagcccgaagacgatcgcgaacatcatcatcggtacgtaggactcgacgggcaccttctcggtgatgcccagcagtgcgcctccccagccccattggaacaccgcgacgaccacgccgtaggcggcggcgatggagaagagattgagcacggcggccttgagcgccacgagcgggctgcggaacacggtgagcagcagcaggaacgcggcggcgacgaccacggcgatgatcagggggagtttggcggcgagggtgtcggtgaaggtctgggcggcggcggtcgtgccggtgacgtagccggtggcccccgtgcccgacagcgtccgcggcaccgtctcgtcctgcagggtgtggatcaggtcggcggtggccgcgtcctgcgggccggtggtgggaaccaccgtggtgacgatcagggcgtggtcggggctggggactgggggagtgacggaggcgacgcccggtacggcggccagatcgcgccggagcgaggccgcgaggtcctggcgcaggctctcgctctcgacgtgccggctgtcgaggtgggtgacgacggtgagcgggccgttggcaccgggaccgaagccctcggtgatcaggtcgtaggcgcggcggtcggtccggctggtggactgggcgccggcatcgacgtgtccgagctgcattgacgcgacggggacggcgagcacgccgaggacgagcaggccgctgacgaggaacagccacgggcggcggctcacccggacggcccagcggtgccagacgtcggcctcaccggtcggttccgcgaccggctcgcggacgtggaagcggtcgatgcggcggccgagcaggcccagcagggcgggggtcagcgtcacggaggccgcggcggccacgaggacactgagtccggcggcgacaccgagggcgccgatgaagcccacgccggaggcgcagagcccgcccagggccatggccacggtggcggcggcgaccagcacggcccggccgctggtggcgaccgtacggccgaccgcctcggcgggttcggttccggcgtgcagcagcgcccggtagcgggtggcgaggaagagcgcgtagtcgatgccgacgccgaggcccatcatcgcggccagggtcggggccgcctgggcgaagccgaagtgcccggcgagcagcccgagcccggacaggctcacggccaggccgatcacggccgtcaccaggggcaggccggtggcggcgacgctgccgaagccgatcagcaggacgagcacggcgacggccaggccgatcgcctccgaggcgcggtcggcggacttcgggctggccagctggccgagcggggccccgtactcgacggtgacgtcgtcggcgcgcagcggttcgacggcgcggtccacctcggcgaggtaggcggggtcgaaactcgccgggttcccgtcgaagcgcacggtcacctgggcggtcccgccgtccggggagaccgcccccggggtggtgagcgggtcggtcaccgacaggacgtccgggagccggcccagatcggcgacggccgtgccgatcgccgcccggtgatcggtgaccgcgccctcctcggtcgtgatcacgatggcggaggccgtgccgccggacccggtggtgtgggcggtcagcaggtcggcacccgtctgggtgctggtaccggggagggagaagctgtccgcgtaggagccgccccacgtgtggttggcgagcccgaggccgaccagtgccagtacccacagggcgacgacccgccaggcgtgccgggcgcaccagtgcccgctccggtgcaggagtcccggccgctgggccgattgagtgttcatggggccactgtgcgcggtgtgtgtaagggggccgtgggcgcattgttcggggaatgtacgggaggctcccgccgggcccccgccgggctcacgcgggggcgggctccggcgggagggtgaccgtgaagcaggcgccgccttcggggccgtggccctcgacccggatgccggcgccgagtcggccggtcaggcggtgggcgatggccagccccaggccgctgccgaccgggcgggtgttccggtagcgctcgtggagggcgccgtggtcgaaggcgatgcgtacgtcgtcgtcggtgagtccgggcccgccgtcacggacctgcagttcggccccgccgcccgtggcactcgcgcggacggcgaggaccaggggcgctccctcgggggtgacccgcagcgcgttctgcaccagcccgtcgatcagctgccggacccggaaggcgtccgtcgcgacgacgacgggccggtccggccgttcgagccggaggtcgacgccgtggcgtgcgcacagtccggtccagaacgcggcggcctcggagacgagcgcggtgaggtcggccggggccacgtccaggcggaagtcgtcggcctccagccgggccaggtccagcaggtccccgaggaaccggtccaggcgccgggtctcgtcggccaggatgccgccgacctcgggtacccgatccggctcgatcaggccgtcggcgagtgcctcggcgtatccctggagcgcggtcagcggggtgcgcagatcgtgggagacggagagcaggaactcgcgctgccggttctcgctgtgggccagcgcctcgtccagcacgttgagggcgcgcccgatgtccgcggtctcccgggggccgtcgaccggggccggtacgccgcgttcgccgtcggcgagccggtgcgcgatctgtgcggccgtcacgagcggacgggcgatccggcgggcgaggagcgctccggccagggccgcgccgagcatgccgacgaccagcgggacgacgacgttgcggcggatccggttcgtgtcctcggtgacgaccgtgtacggctcggtcagcaccaccgctccgccgcgtacggcgggctgcccgaccagcagcacctcctggccgccgaggatgccggtggtggagaccggatcccctgccagcagggccgatttggacgtcctgtcgacggcggggccggcggttccgtggacggcgccgtccggggcgatgaccgcgatctgcaccccgttgggccctgccaggacctgggcgccggtgaacagcgcctcggacacggccggcaggcggctgagcaccgtcgcctggcgtgccagctggtcacgctcgcgctgttcggccccgtgtgcggcggtctgccaggcgatcagtccggtgagggccaccgcgagcgccgccaccacggtggtcagcaccacgatcttgcgtgcgagggagccagggccggcgcggttcacgggccgggagccgtcgcgctgtacccgacgccgcggaccgtacggatcgggctcgcgtcgccgagcttggcgcgtacctgcgagacgaagacgtcgaccatgcgggtgtcccggtagccggggtacccccatacctgggagagcagttgctcgcgggtgaagacctggcccgcgtgccgcaggaggtgggagagcaggttgaactcggtggcggtgagctcgaccggctcgccgtcgcggcggacggtacggctgaccgggtccacgctcaggcggccggcgctcccggtcggcggcggacccggcgggccggccacccggcgcagtacggtcttgacccgggcgaccagctcgcgcggtgagaacggcttggtcaggtagtcgtccgcgccgagttcgaggccgaggatccggtcggcctcctcaccgcgggcggtgaccagcaggaccggtgtccagtcgccggcgtcccgcagtgcgcggcagaaggcgatgccgtccatgccgggcaggccgatgtccaggacgatcgccaccgggtgcatgcgccgcgccgccgcgagaccggcggacccgtcggcctcgacgtggacaccgaaaccctcgcgggtcagatagaggcgctgcacgtcggagatgtggcgctcgtcctcgacgatcagtacgaggcccctggactccgtcatcactgcctctcagccgcggttggcagcatcgatgctaaccgggccgccccgcccttccggtgggcgcgccgccatccgtacattccccgaacaatgcggcggccgcagtccgatccgaagggaaatgccggaagtacgcctctggccggtttcggctcttgcgatcgccctggtccaggccgagttggaccagggcaggaaggcgctcgccgacggcatccggatgttcggcggtacggagtcaatgaacaagcaacaaccgccgccacccgtccgtcgtcgtcgcctcccgcctcccgaggatggccgcaggactgttcgccggcgccgtactgggcatggcgggcgcggccctccaggccgtcagccgcaacgtccttccacctgccggtggtcgcgccaccgcccgcaccgccgactgctcgccggcagcagtggttcgatccgcgcccactgcgcgtcgctcagatcgcccctggattccacggcactgccaacggccgccggcgtgccaccggcgtccaggcggcgctgcttcggcgaagcccgcccccgggcgtgcgggctcctctatcgtcaagtggcatggggacgatgggggctgacgggtcagtgagctcggtgccgttcacgcggatgccgccggtgttcgaggaccggacccgagacgcgtgcgtggtggtgcccgggatcatggggagcgtccttgaggacgtcgcgacgggccgcccgctgtggggcgtggacctggcgatgctcaccaacccgctgaccggacgtggcctgctggatgccctgcacgcggaccagcgggagcgggaagccgacgccgacaccgcccggcgggcgccgctgacccgcatccgcgcaaccgctctgctggccagaccgtggtggctgcccgtcctcgaaggcctcgacccctacagcgacctcctcaagagcgtgaccggtgtcgtcctggccccggaggcgctggcgccgttcccctacgactggcgcctggccgtctcctacaacggcgccctgctggcccgcgcggcccgcgcccacctgacccggtggcgggagcaggtcgccgccgcacccgggtgggcggcggcgggcagggtcaggccgcgactggtgttcgtggcgcactcgatgggcgggctggtggtacgggccgcactcgagcaggacccggagctggcagccgacactcggacggtcatcacggtgggcacgccgttcctcggctcggcgaagtccgtcctcgcgttcaacctcgtcaccccccaggcgaagccttcctggctgcagcgtagcgttcaggcgatctccgcgaccctgcccggactgcacgacctgctgcccggctaccgctgcctggacctgggccgggatgtggagcgcctcaccggcgcggacgtggccaggttcggcggcgatgcggatctggccgcccgctcgctggccgagcacgcccgctaccgccgggacggtttcgcgctgcctgggcaccgcgcgatcgccggcgagtcccagcccaccgtccagacgctcgaagaacagcagcaggcgccgggtgtggccgtggcggccggacgccatcacgccttcgacatcgacgacgagctcgaactcgtccgcgaccccgccaccggcatccccgcccgccgcaacacctacggcgacggcaccgtccacaccccctccgcctgcatcggcaccgaggccgtcacctacgtctacggccagcacggcaccctcatgcgccacgacgaggtcctgcggcagatccgccggatcgccctggaacgcccccaaggcgtccacctcggcgccgacggcaccggcccaggcctgcagactccccacctcggcggaaccctcggacagccgctcaccctcaccgtcaccggcctggaatccccggccggcgtcaccttgagcgtgcactccgcaaccaccggccgccccggccaccccctcaccctgcgccgagacgaggaccgtacggacggggccctgtcggcccggttcaccgcggacgccccggacctgtaccgggtggtcctggacaccggccgccacgcacccctcacccagctcgtcctcgtcaccgaacccgacgcctgagacccaccgccctcccgtgaccacaaaccaccacgccacccctccgccgcacccggcccccgacgacaccagccaccaagggctcgaaccgctccccgagggcggcgtcgagctgctcccggtcaacttcaccacctaccagcacgacagcctgcccgacctggacaccgagcggcacgtgcggggtattgcccaactgctcgctccctacggcgcgcgcaccaccgcatgggcggtgccggccgacaagcgcgaccggcaggccgtcgaggaccgtctagccgcctgggctgacgcgacacacccacccagccggaacacggtgctgtactgggtcggccacggcaccgccggccatctcgcccaccaccgcacccccgcaccgatcaccaacggcgtcacacctgccgacatcgcccaggccatcagcagccgccaactccaccccgccaacgccgacacctgggcgatcgtcgtcctcgatgcctgcttctccttggagttcgccagagccgtccaccgcgaactcttcgaccgccgtggtgtcagccggtacctgctgctgtccaccgccgcccagggctacgccgaactgggcgccctcacccgcgccctggaccgggccctgcacatcaccttccccacccagcccgccatcggcctgctcaccctcggacgccacctcgccaccgaactgggcggcttcgtcgaagacctcactatcgacgaccaccgcgaccaactggtcagccgaaccgccaacgccgcagccgcggtctccggcccgctcgaccagatcgccgaactccaggccgtcatcgaccagctccccctcgacgagcagcgccactttctacccaaggcatccggtgccgaactcggtgaactcgcctggtacttccacggccgcaccctgcaacgcgaccagatcctgcgctggctcgccaccgccaccaacggggccctggtcgtcaccggccccgccggcgccggcaaatccgccctcctcggccacgtcctgctctacaccagcacccgcctgcgtgacatcctgacccgccacggccatctcacacccctgccgcccggcaccccccgccccgacgacccgttcaacctcaccgtccacctcgccggcctcacccccgcccgcaccctccacctcatcgcccaagcagctggcctgcccgacctcgcccagcagtcagccgaaggtcggccccccgccgacctcaccacccgcctcctgaccgcactacgcgcacgtgacaagccgctgaccctgctgttcgacgccctcgacgaagccgaacaacccctcgtcatcgccgaccagatcctgcgccccctcgccgccctcccccaggtccgcctggtcgtcggcacccgccgctccacccgcgaaggccccgaccagcccgccccctacgacaccgacctcctcgaagccctccacccccgcccggccgcaaccggcaacgcccaggaggccggcccgcggtgtgtcgaggtgacgcaggaccctgaagccctcgccggatacctgctcgccaaactccacgccgccaaacaccgcggcgccatcaccgccgacgacgcggtcatcgccgatgccgtgcaccgcctggtcaccgaccacgagcatgtcggcgccgaaccccagcagttcctctacgcccgcctcgccgcccacgaactcctcgccgaccccgccctcctggccgaccccaccccgctgatcggccgcacccaccgccagctcttcacccacgccctccagcggctgcaccgcaccgacccccgctacacccccctcctgcgcgccctcggcctcgcccaaggccgcggcctgcccgaccaggacggcatctgggccgccaccgccgacgccctcaccaccgccggggcgggcgacacccacgctggtatcgccgggctggtccgcgacgccgccccctacctcgccctcgaccacgaacacggccagagcgtctaccgcctcgcccaccgcaccttcaccgaacacttcaccaccgcccccggcacccccaccgcccacgccgccattactcgcgccctcaccgaacacgcccgccacaccctccacgcccaggcatcgcacgccggcaccaccccgcggccccaggacgtcagcccctacatccgccaccacctcaccgcccacacccgcctcggccacgccgccggagccctggacacactcgccgaccaccccgacgtcctcgacactctcgacctcaccgccgtcaccaccaacaccttccatggcggcctcaccccgaacgacctgccgcccgccatcgccggcatcgtcctgctccaacaccgcgctcaggagaccggcaccgaccgaccggaccacagcacgctcgggtggcggcggtggttgcggcggctcggcaccacctacatccaaggcaccccgccccccgccgaaccccacaccagcccccggacctggccgcccactctgaccgtgggcaccgtccgccgtcgccagctccacctacaactcagcggccacacaggcgagttgagggcggtggcggcgttcaccgccccggacggcaccgtccgcctggccaccgccggcgaagaccggacggtgcgggtctgggaccccgccaccggtacccaggtcggcgaacccctcaccgcccacaccggcggggtgaacgcggtggcggcgttcaccgccgcagacggcaccccccgcctggccaccgccggcggcgacgggacggtgcgggtctgggaccccggcaccggcacccaggtcggcgagcccctcaccggccacaccgacagggtgacggcggtgacggcgttcaccgccccggacggcaccccccgcctggccaccgccggcgaagacaagacggtgcggatctggaaccccgccaccggcacccaggtcggcgagcccctcaccgcccacacccgagggttgagggcggcggcggcgttcacggccgcagacggcaccccccgcctggccaccgccgacgaagacaagacggtgcggatctggaaccccgccaccggcacccaggtcggcgaacccctcaccgcccacaccgactggatgacggcggtgacggcgttcaccgccgcagacggcaccccccgtctcgccaccgccggcggcgactggacggtgagggtctgggaccccgccaccggcgcccaggtcggggagcccctcaccggccacaccggccgggtgagggcggtggcggcgttcaccgccccggacggcaccgtccgcctggccaccgccggcgaagaccggacggtgcgggtctgggaccccgccaccggtacgcaggacagcccgaccctcaccggccacaccgaactggtaagggcggtggcggcgttcaccgccgcagacggcaccccccgtctcgcctcggccggcctcgacgggacggtgcgggtctggaaccccgccaccggcgcccaggtcggcgagcccctcacgggccacatcgacagggtgcgggccgtggcggcgttcgccgccccggacggcaccctccgccttgccatggccagcggcttcgacgggacggtgcgggtctggaaccccgccaccggcacccaggacggcgagcccctcaccggccacaccgaactggtaagggcggtggcagccttcaccgccccggacggcacccccccgcctcgccattggcggcggcttcgacgggacggtgcggatctggaaccccaccaccggcacccaggacggcgagcccctcaccgcccacaccggccgggttgacgtggctgtggtgttcactgcacccgacggcaccccccgcctcgccacctgcagcagcgaccggacggtgcggatctggaaccccaccaccggcgcccaggacggtgagcttctcacccgcaccaagcacaaaagctgggtgctggcggtggtgtccttcactgcgcctgacggcaccctccgccttgcttcggccagtcacgacatggtgcggatctggaaccctgccactggcacccaggacggcgagcccttcaccgcatacaccggcggggtgacggcggtggcggcgttcaccgctgcagatggcacccctcgcctcgccatcgccggcggcgacgggacggtgcgggtctgggaccccggcaccggcacccaggacggcgagcccctcaccggccacaccggccgggtgacggcggtggcggcgttcaccgccgcagacggcaccccccacctcgccaccaccggtgaagacaagacggtgcggatctggaacacccgcagcagaacagcacacatactgcccatagcagaaacggccaatgcactcatggaatatcaagggctgctcatcgcaggaaccgactcgggctacctcgcgatcgacatctcgtccgtacccaccgacacagcatgatcgacaggacagggcctcggccgagtgacatgccgaggaccgggtaggaggcttcgcacccggtccccgcgcgtggctcagcggtgcgtgaagcggggcgggcgcttgtccacgaaggcggacatgccctcctcctggtcggccgtggcgaagaccgcgtggaacagccggcgttcgaagcggactccctcggcgagggtggtctcgaaggcccggttcacggcctccttggccatcatcgcgaccggcttcgacatcccggcgacggtctcggcgaccgcgagggcctcggacagcaactcgtcggccgggacgatccgggagaccaggccggcccgttcggcctcgaccgcgtccatggtgcggcccgtcaggcacagttccatcgccttggccttgccgacggcccgggtgagccgctgggaacccccgatccccgggatcaccccgagcttgatctcgggttgcccgaacctcgcggtgtccgcggcgagcaggatgtcgcacatcatggcgagctcgcagccgccgcccagggcgtagccggagaccgccgcgagggtgggcgtacggacctggccgagccggtcccacgccgtgaaccagtccgagaggtacatgtccatgtagctgcgcggccgcatctccttgatgtcggcgccggccgcgaaggccttcgcggagccggtcagcacgatgcagccgacctccgggtcccggtccagttcctccgcggcggccaccacctcggtcatcacccggaggtcgagggcgttgagggcctccggccggtggagggtgaggacggccacccggcccttgcgctccagcaggacggtttcgtaggtcatgcggctgttccgttccggggtcgcagggtgtggacgatcgccgagaagtcgaggccggcgccctcgcccgcagcgaagtcggcgtacagctcggcggctttctggcccagcggagcctccaccccgccggcccgcagggcgttcgccgccagggcgaggtccttggccatcaggggcgcggcgaagccgggcaggtagtcacggttggcggggctgcccggaaccggtccgggcacggggcagttgacggtgagggcccagcactggccggaggcggtggacgccacgtcgtagagggcctggtggtccaggccgaggctctcggcgaggacgaaggcctcgctcaccccgatcatcgagacggcgaggatcatgttgttgcagatcttcgcggcctgcccggcgcccgccgccccgcagtgcacggccttcctgcccatcgccccgagcagcggctgggccgccgagaactcctcggcgccgccgcccgccatgaaggtgaggctcgccgcccgcgcgccgaccaccccgcccgagacgggcgcgtcgagggaccggtgaccggccgccccggcggcctcgtgcgccgcccgcgcgtcggccacgtcgatggtcgagcagtcgacgaacagggtgccgggccgcgcggcgccgagcaggccgccctccccgtacagggcgaggacgtgtccgcccgccggcagcatggtgatcaccacgtcggcgtcggcggccgcggcggcggccgagaccgccggctccacccccgtcgccgcggcagcggccagcagctcgggcaccaggtcgaagccgaggacgcggtgtccggccccgacgaggttggccgccatcgggccacccatgtggcccagtccgacgaacgccacggtcgtgctcaccagggcacctcctgagtcgattccgcatgggtcagccccagttcgcgcgcgccgagcggggcgaagaaccgttccacgtccaccgggcccacctccgccagggagggcggcgaccaccgcgggctgcggtccttgtcgacgacctgcgcgcggatcccctccaccaggtcgggggaggacagcgccgcgcaggagatccggtactcctgctccagagccctttccagcgggccgagttcgcgtacccggcgcagggcggccagggtcaccttgagcgccgtgggggacttggccccgagcgtggccgcggccttctccgccgccgggacgccgctgcggagcaggcgctccacgatgtcctccaccgtgtcggccgcgtagcagtggtcgatccactcgcggtcaccggcgagcgcgccaccgggcgcgggctcgacgtaccgttccagcacctcgtgtacggaggcccgcgccaggtccgcggccagccgcggcagcagttccgagggcacgaaatgatcggcgaggccgcagatcagcgcgtccgccgccccggccggggcacccgtcagggcgaggtgggtgcccagttccccgggcgccagcgccagcaggtacgtgccgccgacgtccgggacgaagccgatgccggtctcgggcatggccacgcgggagcgttcggtgacgatccgcacggtgccgtgggccgagatcccgacgccgccgcccatgacgatgccgtccatgagggcgacgtacggcttggggtagcgggcgatgcgggcgttgagccggtactcgtcgcgccagaaggctgccgaggccgtgccgcccgtgcgggcgtcctcgtagatcgcgcggatgtcgccgcccgcgcacaggccgcgttcgccggcgccctcgacgacgacggccgcgacggccgggtcgtgctgccagccggcgagcgcctcgtcgatgcgcagcaccatgggacgggtgagggcgttgagcgcctgggggcggttgagggtgatgtacgcggtgtggccctcggtccgcaggagtacgtggtcctggtcccggtcgtggtccccggggtttccgtggttcatcgcagggcctccgtgagcccgcgggcgacgatgatgcgcatgacctcgttggtgccttccaggatctggtggacccgaaggtcacggacgatcttctcgatgccgtactcgctcacgtagccgtagcccccgtggagctggagggcccggtcggcgaccgcgtagccggtgtccgtggcgaaccgcttggccatcgcgcacagctgcggggccagcgggtcgccccggtccagcgcgtcggcggcctggcggaccagggcgcgggccgcggccagctcggtggccatgtccgcgagccggaactgcagggcctgggcgtccagcagccggttcccgaaggcctgccggtcggccaggtacgcgaggctgcggtccagggcgctctgcgcaccgcccagcgagcaggcggcgatgccgaggcggccaccgttgaggccgttcatggcgatgcggaagccgtcgccctccgcgccgagccgccggtcggcggggacgcggaccccgtcgaggatcacctggcgggtgggctgggcgttccagcccatcttgcattcgttcgggccgaaggagaccccggggtccgcgcgttcgacgacgaacgcggagatgccgcccgggccctccccgcccgtgcgcgccatcacgatgtagacctcggaggcgccggcgccggagatgaactgcttgaccccggtcagcacatagccgtcgtcggtgcgctcggcccgggtgcgcagcccggccgcgtcggacccggcgccgggttcggtcaggcagtagctgccgagcgaccgggcggagcacaggccggggagccagcgggaccgctggtccgcgtccccgtaccggtcgatcatccaaccgaccatgttgtggatggagaggtacccggcgatggaggggcagccggtggcgagggcctcgaagacgaggacgccgtcgccgcggccgagggcggaaccgccgtgctcctcgcggacgtagacgccgccgagcccgaggtccgccgcccgccggatcacgtccagcgggaagtgcttgtcctggtcccaggtgacggcgtacgggccgagctgctcctgggcgaagtcgagggtgacctcggcgagggcgagctgatcgggggtgagggtcgtggtcaccggctcaacccatcgtcggaagggtgaagctcgcgccctccttggccccggagggccagcgcgaggtgacggtcttggtacgggtgcagaagcggatggcgtcggggccgtgctggttcaggtcgccgaagccggaccgcttccagccgccgaaggtgtggtaggcgacggggacggggatgggcacgttgacgccgaccatgccggcgcccacccggcgggtgaagtcgcgtgccgtgtcgccgtcgcgggtgaagatcgcgacgccgttgccgtacgggtgctcggtgggcaggcgcagggcctcctcgtagtcggcggcccgtacgacggacagcaccgggccgaagatctcctcgcggtagatccgcatctgcggggtcacccggtcgaagagggtggctccggcgaagaagccgtcgccgtgcccgggcagggtgaaccctcggccgtccacaacgagttcggcgccttcggtggccccgatgccgacgtagcggttcacccggtcgagggcgtcgcggctgaccaggggcccgaaatcggcctcggggtcgtcggagcggcccacgcgcagagtggcgatgcgctcggccagcttggccaccagcgcgttcgcggtctcctcgccgacgggaacggcgacggcgatggccatgcagcgctcgcccgcggagccgtagccggcaccgatgagggcctccacggcctggtcgaggtcggcgtcgggcatcacgaccatgtggttcttggcgccgccgaagcactgggcgcgcttgccgtgggccgcggcggcggcgtagacgtgcgcggcgacctgggtggagccgacgaagccgagggcctggacgcgggggtcttcgaggagggtgtcgacggcctccctgccgccgttgaccacattgagcacgccgggcggcaggccggcctccaggaacagctcggcgaggcgcagcggtacggacgggtcgcgttcggagggcttcaggatgaaggagttgccgcaggccagggcgggtgcggcctgccacagagggatcatcgcggggaagttgaagggggtgatcccggcgatcacacccagcggggagcgcagggagtgcacatcgatcccggtgcccgcgctgtcggtgaactcgcccttcagcaggtgcgggacaccggccgcgaactcgaccacctccaggccccgttgcaggtcgccgtgggcatcggcgacggtcttgccgtgctcggacgacaacagccgggcgagggagtcccgttcgtcctcgaccagctggaggaagcgcagcagcacgcgtgcgcggcgctgcgggttccactgcccccagtcggcctgcgcctgttcggcgtcggcgatggcggcctcggtgtcggcccgccccgcgagcgggacccgggcctgtacggcgccggtgttggggtcgtacacgtcggaaaagagaccggaggttccggtggtgtgcttgccgccgatgaaatgggtgagttcacggaccatggatgcctgctctcgtcaggtgggatccggggatggcacggcgggccggcggacggcacccgatcgggtgcgccgctggggaaggccgtgggactgggccgaaaggggacgacctatgagcgcgcgaacgtgtgcgcgcgctccgccggatcaccagggtcgtgggtacaaaccggtgccatgcgtgtctgctccatcctcgtggacaacacggaacatccgcggccggtatcctgactcccggatccccgcgtgccgcccgccttcccgacagacctcgtcagtggcgtgtggatggcagcacactccccggtcacagtggcgggaccgtgccggtttctcaccggcttccctgcaccgcggaccttgtgccacgaacatatagttggacgtcctagtaagtccagagccgccgcgcgccctctgtgcgacggtgcctgacgccggctcagccccgggccggggcagggttcccggtcaccgggtacgggacgaaggtgctgctgttctcgtccacggccagcgcccggccgagcggcggcacggcgcgctgcgggcagtcgagccgttcgcacaggcggcagcccatgccgatgggcgtggcggccgccgtgttgccgaggtcgagcccgtcggcgtagacgagccgcgaggcgtgccggatctcgcagccgagcccgatcgcgaaggtcttgccgggctcgccccagccgccgcggtggcgggtgacggcccgggcggtccacaggtaccgctgcccgtcgggcatggccgccacctggacgtggatacggccgggcgcggcgaacgcctcgtagacgttccagagcgggcaggtgccgccggcccgggagaagtggaacgcggtcgccgactgccgcttggacatgttcccggcccggtccacccgcacgaaggagaaaggcaccccgcgcagcctgggccgttgcagggtgctcagccggtggcagaccgtctcgtagccgatcccgaagtggtcggtgagccgctcgatgtcgtagcggaactcctcggcggccgcgtggaaggcgcggtacgggaggatgagcgcgcccgcgaagtggttggcgatgccgatccgcgcgagggcgtggacgggggagccgggcgcgaagtcctcggccgccagccggtccagctcggccccgtactcgacgagcgccagctgggtggccatccggaacgcctgctgtcccggccggagccggttcgacaggtgcagcacgcgggcggcggggtcgtagtggtgcagccggtcggagtccgtggccgtcctgatcccgtgccgctcggagagccggcgggtcagcgcacggacgacgtcccccgggcggatgccgatctcggcggcgaggtcttcggcggcgagatcggtgtcgtggaggtagttctgccggcggtagaagaactcgcggatctcctcgtggggcgagcgcgggctgtcggcggccacgtccctgccgtcggccgcgtcggcgaggcgttcggccaggagctgggcgcggcggcccaggtccagcaggaccgaggcgacggcgggcatccgggtggccagttcggccaggtcggagggggagacgcgggcctgcgccacctcgttcgcgagcgcctcgcgcaggtcggcgaccagccggctggtgtcgcgctccgagaagaaccccggatccaccccgaaggcctcggtgagccgcagcaggaccggaacggtgagcggccgggagtcgtgctccatctggttgaggtaactgggggagatggcgagcacccgggccaggtcggcctgggtcatccgccgctcctcacgaagccgccgcagccgcgctcccgcgtacgtcttgcccaccgcactccctcgccgtctgccgggccggacacgagccgccaggatacggggatcttcacgacctccgggcttcgcaaccttggcaattgtcgccccgaagattcgcagagcttggcagatgtacctccttgatggcacccggtgtcactgccagagtcggtgctgcggcccgccggacacggtggccgggaagaaccgactggcctgattcacgccctgatttcggccatccagacagttcgatccggcggatcggcagcattgctcagcttcggcccagggccgggtccggcggccgcagctccccaccaggcacagagtgccaaggtgccgggctcacggaccggctccttggcaagacaagcgacggatggaaacggtgacggtcatggcagaggcgaacacgacggcggcggccgagcagctcaagcagcggtgggccgacgacccccgctgggcgggcatcgagcgcacctacacggccgaggacgtggtgcggctctcgggcagcgtccgcgaggagcacaccctggcccggcgcggcgccgagcggctgtggcgacagctccacgaacaggactacatccacgccctcggcgcgctcaccggcggccaggcggtgcagcaggtgcgcgccggactccaggcgatctacctctccggctggcaggtggccgccgacgccaaccaggccggtcacacctacccggaccagagcctgtacccggtcaactcggtgccccaggtggtccggcggatcaacaacgccctgctgcgcgccgaccagatcgccaccgccgagggcggcaccgacaccacggactggctcgcgccgatcgtcgccgacgccgaggccggcttcggcggccccctgaacgccttcgagctcaccaaggcgatgatcgaggcgggtgcggccggcatccactacgaggaccagctggcctccgagaagaagtgcggccacctcggcggcaaggtcctcgtcccgaccgcccagcacgtccgcaccctcaacgcggcccgtctggcggccgacatcgccgacaccccgaccctgatcatcgcccgcacggacgccctcgccgcgaccctcctgaccagtgacatcgacgaacgcgacgcggagttctgcacgggcgagcgcaccgccgagggcttctaccacgtgcggggcggcatggcccccgtcatcgcccgcggcctcgcctacgccccgtacgccgacctgctctgggtcgagaccggcaccccggacctcgcgcaggcccgggagttcgccgaggcgatccacgcgcggtaccccgaccagatgctggcctacaactgctcgccgtccttcaactggaaggccgcgctggacgacgaccagatcgccaagttccagcgggagctcggcgcgatgggctaccgcttccagttcatcaccctggccggcttccactccctcaaccacggcatgttcgacctcgctcgcggctacgccgagcacggcatgaccgcgtacgtcgacctccaggagcgcgagttcgccgcccaggcccaggggttcaccgccgtgaggcaccagcgcgaggtcggcaccggctacttcgacctcgtctccaccgccgtcaacccggcctcctccaccaccgcgctctccggctccaccgaggaagagcagttccactaggccgtctgtgcgccgagttcctgcgacgggtgcccgggggacctcccccgggcacccacccaccgcccccgctgaggagaaccgcatgcccctctcgcctctgaccagcagcgtccaggtcctcggtgcgccgggtgagcgccacgaggagatcctgacccccgaggccctggagttcatcggccggctcgacaccgccttcgcggaccgccgccgggaggtcctcaaggagcgccaccgccgctcgggccacctggccgggggcaccccgctcggcttcccgctcgccacgcgcgccctgcgcgaggacccgcactggcgcgtcgcgccgcccgcgcccggactcaccgaccgccgcgtcgagatcaccggcccgccggagcggcggatggccgtcaacgccctgaactccggtgccaaggtctggatggccgacttcgaggacgccaccgccccgacctggaccaacgtcatcggcggccagctgaccctgctcgacgccatcgaacggcgcatcgacttcaccaccccggagggcaaggagtaccgcctcggcgcgcagctcgcgaccatcatggtccggccgcgcggctggcaccttctcgaagaacacctggagatcgacggccgcccgctgtccgcgtccctcgtcgacttcggcctgtacttcttccactgcgcccagcggcagatcgacgcgggccacggcccgtacttctacctgcccaagctggagaaccggtacgaggcgcgcctgtggaacgatgtcttcctgctcgcccaggaactcctcgggatcccccgaggcaccgtccgcgccaccgtcctcatcgagacgatcaccgcggccttcgagatggaggagatcctccacgaactgcgcgaacacagcgcgggactcaacgcgggccgctgggactacctcttcagcctgatcaagaccttcggccaccgcaccgacttccagctgcccgaccgggccgcggtcaccatgaccgcccccttcatgcgggcctacaccgagctgctcgtccgcacctgccaccggcgcggcgcccaggccatcggcggcatggcggcccacgtccccagccgggacgcggaggcgaacgccgccgccctcgccaaggtccgcctcgacaaggagcgggaggcggaggacggcttcgacggctcctgggtggcccacccgggactggtgccggtctgccgcgaggtcttcgacggcgtgctgggggagcggccgaaccaactggaccggacccgggaggacgtcgagatcacggccgccgacctgctgtccgtacgccggatcgccgcaccccccacccgcgagggcatccgctcgaacgtcgccgtggccctgcgctacttcgacgcctggctgcgcggcagcggcgccgtggccctgtacggcctgatggaggacgccgcgaccgccgagatcgcccgcgtccagatctggcagtggctgcgccacgaccggacggaccgggcgacggtcctcgacctcctcgacgccgaatgcgcggcgctggaggaggaggacccgtcggcccgggtcgccgaggcccgggaggtcttcgtgaacacggcactcaccccccgcctgcccgccttcttcacccccgaggcctacacccgccacctcgtgagccggacggagaaccgatcatgactacgccgaaagcgtcgatcgcgccgatccagcgggtcggcatcgtcggaggcggccagatgggcgccggcatcgccgaggtgtgcgcccgcgccggcctggacaccgtcgtcgccgaggcggacgccaccgccgcccggaccgcccgggagcgcgtcgcagtctccctcgaacgggccgtgcagcgcggcaaactggaccggatctccgccgaggacgccctggcccggctcgtcttcaccggcgacctggaggacctcgccgaccggcagctcgtcgtcgaggccgtcaccgagaaccccgaagccaagaccgaggtcttcgccgccctggacaagatcgtggcggacccggaggcgatcctcgccacgaacacctcggccatcccgatcatgcgcctgggcatggccaccggccgcgccgaccgggtcgtgggcctgcacttcttcaacccggtccccgtgctgccgctcgtggaggtcgtctcctcactccacacctcgcgcgacaccctcgcggccgtggaggccttcgcccgcgacgctctgggcaagaccaccgtccgctcccaggaccgggccggcttcgtggtcaacgcgctgctgatcccctacctcctctcggccgtccgcatggccgaatccgggttcgccgcccccgaggacgtggacgccggaatggaactgggctgcgcccatccgatgggcccgctcaagctcgccgacctgatcggcctggacaccgtcgcggccatcgcggaatccctctacgaggagttcaaggaacccctgtacgcgccgcccccgctgctccagcggatggtgcaggcgggtctgctcggccggaagaccggccgcgggttccacacgtacggccggggctgaggggccccggcaggtctccagggcagagggtgcgccggagacgtacggaacggcgcgggtggggcgagtggtgtcgccacacccgcgccgcaccgcttacgaaagagacggcctagcgggcgggccgcgtcagcaactgcgccaggtggtcggcgaactccgtgatccagtcgagggccggcccgctgcgggcgacccggaagccgtgccggcggccccagaacgcggcctgcaccgcatggagttgggcccatcgccggacccgttcgcgatcgagctccgcggcctccgcgaagaggtccagggtgcggtggaccgcccggccgaggtcctcggcgtcgaggagggacagcgcgcgcgccttgagcagagtgccaccgtcgtaggcgggatcccccacgtaccccttggggtcgaccgcgagccacggctcgcggtccgcgcgcaggatgttcctggcgtggaggtcgccgtggatcaggacgtccggctgggtgcgccccagctcgcggacggtcgccaccgccgcgtccaccacgtacggcggcaccgtgtgcgtcaactcgccttcgtctctgcggagttgctgctcccaggagtcggcctgcgcgcgcagtcgggggaggtgggccggcgcggggacggccagccggcggctcagccgccccgccaccgtcaccacctcgtcgccgtcccggacctcctccagcgtcgacgtccggacccgctccagcagcatcgcgaagcgctcgtcatcgcgctcgtgcagcaggacggccccgcgcccgccccacgcctcgaacgcgtccggctcgtggacgttcccgggatgcgggaaggagaccttcagcacggcccgctccgcgtcccgccgcagcaccgggacgatgatcccgacacccccgtgcatgacctcgccgtccggtacgcactcccagcgcgccagcaactcgtccacgattgacggcagttcggcgagccatgcggccccggccgctccctcgcgctcgacggtgccgcgcgtgaagatctctggtgtcccgaccatcccggtaccctacgctgagccgcatgatccaacttcctgtccgtccacgaccggccctcagggcgactccgagccgccgggggcgctgagatgccgcccttcacctaccggctcaccctggccgcggccgtcccctcctccctccgggagcaggtggccgaggccttcgtcgccgccgcgcgccgcttcgccctggaggccggcatcgaccggctgacgatcgacaacccgatggcgcgcgggttcttctccttccgatcccatcccgccccgcgcgccccggagctggcggggctgttccccaccgaccggccgggcccgtccggccccctcccgccgtccggttaccacgacggcgcgcgcgtaccgctcgacaccggcctggaactgctgcgggccgtgctgctgcgcgagggcccctggtgccgactgcacgccgagggagggttcttcctccacgtcggggaacggcacgacctctacaccgggggcgcgacgccgtacgcggacgccgcggcgcacgcccgccgagcggggctgaccgtcgaagcggtcgaacgctccccgtacgatcccgccctcgacgagagcgaccccctgccgcccgcggacgcggccttctggacggcggtccaccgcctggtcgccgagcacggcggggtactggtcgaggagcggtacgtcggcggcgaccaccggtggcaccggccggccacggccgccgagatcacccgggtacgggcgctgctgaccccgcgggcccggctggcggtgtggccggacctgaccgacgacaccgaggcggtccgcgccgccgtcctccgctcggaacgcctcgaactcctggtccagcaggattgcgacgggatcccccgggcacgcctcgccgagtcctggatgggccgcaccgacatcgccttcccgatgatcgggagtggcccggggtgccgggccggcctggtcccgctcgcaccggccgatcgccgcccgctgctcgccggagtgctgcccgacgccgacggcgtcgtacgggcacgctggcgcaccaaccgcacgccggccgacgagcggcggaccctgctcggttcgctgcggaccggcgacgtggtgaccggcaccgtcgcgagcggcctggacgacgtcggcgtacacgtgcacctggacgtggagcacgagcggggccggcccctgggcttcctgcgcgtccccgaaatgtcctgggagtacttcgaggacgtggacgaggtggccccgatcggacggcggatccgcgccgaggtcctccacgtcgacctggagcgggagcgcgtggccctgtccgtcaaagcactgagtccggacccttggcgccccctcgccgaagccctccggcccggcgacaccttccccggcaccgtcaccaagaccatcccgttcggcgcgttcgtacgcatcgcaccgggtgtcgagggcctggtccacgagagcgagttcgccggcaggaccttcgaggcaggggacgccgtacgcgtcaccctgctcgccgtggacctggagcggcgccggatcagcctttccccggcccccgaggcctgagcgggcggccaccggcggccgcgaagccgagcacggtcgacagacccgcgagcccgccgcccggctcgaaggcctcggtaccggcgcccacgcttcgggccgccagcgccccccgcatcccccggaccaggtgacacgactggtgatcaccaccgatcaccggttcagtggtgaacgtgggccgatcacagtccgtacccccgcgggaaccccggtgacctccatggaccaccgggccccgaccggcgaccccatgctcacggccaggttcgcgcctccggccgtgccgaaactgctggtccaccggcccgagctgctcggtcggctgacggccggggcgcagggcccgctcaccctcatcaacggtccggccggctcgggcaagaccgtgctcaccgcccactgggcggccggcgggcgcgcgacgcgtccccccatgtggctcaccgtcgaacccgacgacgcccccggcgccttctgggcgtacgtcctggaggccctccagcggggcggggcggcactgccggacgcggtggggcggccgacccgtgccgaaggggtgacccggtcgttcctggtacgcctggcggacggactggccgcgtcgccccggcccgccgtcctcgtcctcgaccagttcgacaccgcccagccgcccgcgacgaccgagggactggacttcgtactccggcacgcggcgggcggcctgcgcatcgtgctcaccagccggtccgacaccctgctgcccctgcaccgctaccgggcggccggcgagatcacggagatccgggacaccgacctccgcttcaccgacgaggacgccggggcgctgctccgcgaacacgggctggacatctcaccggccggaatccggctgctggaggaacggaccgagggatgggcggccggagtacgcctgtgcgccctggcgatgcagcgcagcgccgacccggaggcgttcctgcggcagttcgcggccgaccgcaccacgatcgccgactacctcctcaccgaggtgctcgacgcacagccgccgcccacccaggacctgctcctgcgcgtctgcgtcaccgaccgcgtgcatcccgatctcgcggacgcgctgaccggccgcgacgacggcgcacgcaccctggcagggctggcccgcgacaacgcgttcctggagcagatcgacgcctcggcctggtatcgcctgcacccgctgttcgccgaggtcctgcgcgcacacctgcggcaacgctgccccgggctcgaaccccggctgcacgcgcgggcggcgcgctggctcgcccggaccgggcggctcacggaggcggtgctgcagggcgccgccgccggggactggcagttcgcggcggcgcagctggtcgacaacctggcgatgggccgcctcctcacggggctggaggccgaccagctgggccgggccttcgccgggatgccgcccgggacggccggggtggcgcccgcactggtcgacgcggcctgccggctggcggaacaggacctgtccggctgccaggccggactgcggcgggtggacgcggccctcgcggacgcgtcccccacggacgcctcccgtgcggaaacccacggtccggcggcgcggttcggccgcgccttcctcggcgtactcgccgcgcggccggccgatgacgtgacggccaccgaacgggcggtcgccgacgccgaccggctgctgcgggagctgccgccgcccctgctggccgagcgccccgagctccgcccccttctgctggcacagctcggcaccgtggagctgggcgccggacggctggaccgggccgaatccgccctcacggccgccgtcgccgcatgcgggcagccgggaacggagctcccgctctgcggcgcgctcggctcactggccctgacggaactcctgcgcggccggttgcggcaggcggccgagcacgcccgcgcctcgctcgccgtagccgagcggtccgcgctcccgcccgagcaccgggccgggaccgaccacctcgtcctggcgggcgtggccgtcgagcaggacgacctgcggaccgcccgccaccacctcgacctggccaccgccgcgcgggggccgcgcccggatcccgcgatcgcgacccgggccgccgtcatcggagcccggatcacggcggccgagggcgacccggacgccgcgctcgccgccctgcgcgcggtggaccgggagggactgcccgcctgggcggcggacgagctggccgtggccgagtcggccgtacacctggcacgcggcgaagccgccgcggccctgggggtcctggacgcggtggaggcccccgacggcgaccggccggagcacgcgctggcccgggcccgggccctgctggccgccggccgcgacgtgtgcgcggcgcgggcgctggcgggcgtaccgggcgacgaaggcgccaccaccccggtacgggcccacgcccgcctgctccgcgcgcagatcgccgaggcgcagggcgactcccgggcggcgcaccggcacctcggtgaggcactggccctcgcccgccccgaggaactgcgccggatgttcgccgagagcggctcctgggtgcgccgggccctgcgccaggacccgcggtcggcgcggtcgcacggctggctgacgcaccgcgccccggcccgtacggcgcgcgcggcgcaggccggcggcccgcacgccgacgggcgggcgccggtggtggagccgctgagcgcgcgggaggccgaggtgctgcgcaaggccgcggaactgctgtccaccgaggagatcgcggccgagctgtacgtgtcggccaacacggtcaagacccacctgaagagcatctaccgcaagctctgcgtcacccggcgcagcgaggccgtccacagggcacaggacctcgggatgctctgagccggacccgggtcccctgtggtgtccggccgggaccgcggttctcgcccgccccgggcgatgccgggcggcgggcgggggccgacgatggcgggggagggccgtgagcggcccgggccctcgcaccggcccgggctccgaagccttcgttccgagaggagtgagtgcctcatgcgctacgaattccgcatctcgggggtcgtaccggacacgctcgccgcgagctttcccgagctcgcccggattcccgtaccggagcagacgctcctgttcggcagcgtggcggacgaggcccacctgtacgggctcctcacccgcttccagtccctgggcctgcgggtgctcgaaatgcgccggctgcccgcctgagcggggaccgggtgaagaccacccgcttcgggtgatcacaggaaccggactgccggacgacactgcgatgtggcaccgaagccggtgaccgacgagctagagcaggacggtcctgcgctgcactgccaactgtgaggtgaattccatgggccagccgacaccgaccgggggaaactggaacaccggccctgcgccgggcaacaccccgtcgtacccaggcggcgacagccacggcgcggggaacgtgggcacgatgttcgcggcggtcctcctcctggtgaccggctgcctcgcggtcttccagggcatcgcggccatcgccaacgacgacgtctacgcgcgcatcgggagttacgtcttcgagttcgacctcacggcgtgggggtggatccacctgatcgtcgggatcatcgtcgtcctcaccggggtgggcctgttcgccgggtcgaacctggcgaggggcgccggtatcgcactcgccggcatcagcgtgattctcaacttcatgtggctgccgtaccagccctggtggtcgatcatcatcatcgccatcgacgtgttcatcatctgggccctgtgcacgagttggacgcaggccaccgactgacacgaggcgcgcacggcggcacccgatccggcgacgggtcgcgtgccgccgtgcgcgcgggcggcccgtccgtccggaaaacggcggggcccgtcagccgcggtggggggtcctgcggctgacgggcgtgttcccggctccgtcgtcctggctacgcggcgcccgtcatacgggcgaacacgaccacgttgctgtcgtagtagtgcttctgcgggtcgaagctgccgccgcaggtgaccaggcgaagccccgcgtggtcgatgttcttgtagacctccagggtcgggaactcggccttcgggtactcggcgacccggtccaccgtgaacgtgaccgtcttgccgtcctgccgggtcaccttgatggtgtcgccgcccttcatcgtcttcagcttctcgaacacggcggatgccccgttccacgtgacgtgcccggcgatcacggccggtccctgggagccgggcgtcggccccggctcgtaccagcccgcgagcgcggggtccttcggggtctgcatggtgccgtccgggttctgccgcagcgtctccagggagctggacaggttgagggaggggatcgagatcttctgcggctccgacctggccagcgcctgctcggccttgcccgcaccaccacccgtgcccgcacccgcaccgccctgcgctgcgcccgcggacggcttcgccgcgggagcggcgccgtcggcggcggccggtgccccgccctggacttcctgccccgccggggcggggggcttcgccgcgttctgcccgccgccgcaccccgcgaggaggagcccggcgagggcggcggcggccacggggcccgcgatccggcgacggcgggtccgcccggcggccgaggcgatgggggtggccacggaggtcacgggggccttgagggtcacaggggccttgggggtcacggaggtcatgggggtcatgggggtcatggggtccggcttcacgcgccgcccccggtggtctccctgcggacgggcccgattccggcccgcttccgcccgatgatcaccgcgcccgccaccaccgcgagtacggtgatggccacaccgtcgcgcaccgtcaccggcgtcgacgcgtgcgcctccgtaccgccgccggtctcgatgccgccgacggggatggaccccacggccgcgcccttgacctctccgcagttggtcggagccgtggcctcctggggcagcttcgggtcgagttcgctcttgccggccccctcgaagtcgtacttcttgttcttgttgcggtcgatgccgtgctgcaccacgtgcaggtccttgaggtggtcgaccacgtcctggccgaccgggatcgtgcgcttgtaggagagcttgcccagcttgtcggcgacgggcatgcggtccacggcgagcccactggtcgccttggtgtcgccgaccgtggtgagcgagatgttgatgtcgccgtagtcgtgcgtggcttcggtgttgctgaggacgccgtcgccgtcggtgtcgtcggtcgcgtccgggcagtggaagtcgtgccccttcgtcgagccgtgcagatgctgggccgacggctgtccgggaaccatgcccgtggactcgatctgtacggtgagctggttgcccttgaggctgagcatgaccgtaccgctggagcccgatgcgttcagctgcgcgaggtcgatctggtacgcctttccgccctgcgcgagagctggtccggaaaggccgagggtcagggccacggctgcgggtatggcggcgagaaccacgtggcgaccggcgcgcttgactatcacattcgctcctgttccgtggatccccaggatcgggaatcgcagatcgtacgggattacacgaggccctgaagaggctctcgctcctccttcggagccccaacgcctgcggatgggtgcccatatgaaaaatttctgatgacttcgttcgactgctgcgacctcgtgacatcacgtcggtcgggggcggaagacggcggccccgcagagtctttgcgaaaacggcgcaatttcggggtgcggtcgtgggggaggaccccgaacaccgcaggtaggcggcctacatcaggccgtggcggcgtctttgccgagcggtgggtgaactcaatgaaggaaaagcacagccctgcgcgcagggaggaggccggggaatcccacctccctgcgcacgggccgggtcaggtgagggagtcggaactcggtctttccggtagtaatctgaccgctatcaattggatcctgccgcatctacgcacgcgtatccaccgccttaggcatcattccggtcgccgacgggggcatcatccccgtcggcggggccggtccggtcccgacctttgtagtcgtcgtggcggcggccggacgaatagttgacctctgatgctaagaaatgccgtcagcggtgcggcggccgtcccggctatgtgtgcaccgggaaggacgcctggaaggcgagccggccgtcggccccgtcgccgatgcgggtgagcagatcgtcgagcgcgaggtactcctcccagtgctgtccgcccgtcgctcccgccaggcgcgagatcacgaggtcttcgagctccgggaggcgcttgttcttccagaccttgtcggccgtgctcaccagcaggtcttcgagggtcgtaccgggagccgtccatgaggcgtgggtcccggcgaaccgggccagctccgggccgaacccgtgtgccaacaacagttcacggcccgcctcttcgtgcgccgagccgggctcggacagttcggccgtgtgcacggtcttgcctatgtcgtgggtcgccgctccgaagagaacggccgcgcggtcgacggcgatccgcggatggcgatgctccagccattcgacgagttggaccgccacgtcatgaacggcccgcagatgggcggccagccgcggcggcgcatcgagggaccggagcaggcccgccaccggaggcggcagagaccgcagcggggggtcggcaggggcgtgcagggcctgggacagcgcgtctggaaggggcatcggttcaggctagcgaggagggccggtgttccgacacgtgtacgggaccagcggcgcccggcggcgctccgtacctccgaacggaggcccgggtccacctattcgagggaaccggggggccggaaccaggccgggaggccttcggctgccgaaggaaagggcgacggccccgctcggggccgtgcggtgctccggcaccgctgtgcggttacaaggagattcacgtgtcgcgtgttctgaagagtgcgggtctggccctggtgctgggcctggcggtcatcggcggtgcctcctcggcgtcggcggactccaccgcgaacggcgccgcgatcggttcgcccggtgtgctttcgggcaacgtgatccaggtcccgatccacattccgatcaacctgtgcggcaacagcatcaacgtgatcggcgcgctcaacccggccgccggcaacgtctgcgtcaacgcctgaggctcgtgaaccgcggctcatcccggtcggagggtcgaccgggatgagccgcccgcacgcggcgccgccggggtcaggccagggtgcgtacgtgctggtcgctcagctcgtagcgggcggcgagtaccgccagttcgcccgtcgccacccgcccggccaggtcgggttcggccgcgagccgcctgcggacgttgcgcacgtgcgcgttgatcgtcgcgtcgacgcgggcctcaccgtgccggctgtggtcgatggaaggccgtatctgatcggccaggtactggacatgagccgggagcggcccgcccgactcgtcggcgtggaccgccgcggcgaccgccccgcacgactgatgggccaggacgagcacgagcggtacacccagctcgagaaccccgtacgcgatgctgcccagcaccgcctcgtccagcacctcgcccgccgaccgcacggtcagcaggtcacccagcccctggtcgaagaccagctcgggcggaacgcgtgaatcgacacagccgagcacgatcgcgaagggccgctggccctggacgagccggcggcgcagggccgcggactcgtgcgggtgctcctggtcccgggcccgccaccgctggttgccggccgccagcctgcgcagggcctgcgcgggggtggccacgggctcgtcgctctccggatcccacgaggtggcgaacgcgggaaaggccgcgccgagggtcagccccgctccggccgccgctgtgcccgcgacggcggtgcgcagcagggcgcgacggctgtgcggggcatgggtggttcgtatgtgcgaaggcatggccggaccgtaacccgctgttccggcaggcacgtcggcccggccaccacaatggcgcgatccgctcgggggcaggcttgatggggcctggatcttctcagaatgcgggcgtacaccctgcggggagccgtccggtggcgagccgacgggtggcgagccgacgggtggcgatccacgcgcccgaagccatccgccgcgcccccagggccacctcgccaccgatcccggcccgtgtgcgaggcttgcccggcacccgggaggagaccacacgatgcacacgccgagccggcccgaagacctcgaacaccccgaactgctctgggccagggcggtgaccatggccgtcgtcgacaccgcgcactcggccggcaccgagttcgccctcgacgacgacggcctgtggtgccactccaccggcgggtgcggctggtggcgcctgaccgtgctggacgaggggcacgcggtgttctgcggccaggaccccgacggcagtcacacccatgtcggcgaggagcagatcgacttcctggccggcggccccgactggctgccctgggacctcttgcgcgacgacgccgccgggaatctcttcgggttcgtctactggtgggagaacggcgcctggcaccggatcgcctacccggacgaggtgcgcgaggacgggctggacggagccgccgcctgggtcggcgcggacgagggggagtacctcggactcgccgtgtcctcgttcgacgccccgggcgcgctggagcggagcctgaccgaggccgtcgcccggttcgcggcgctggcacgcgaacgcaaggccgacccggccgccgtggcggccctgctcgccgcgggccaggtcgagggccggcccgctccacgcctcgacgcggcactcgacctcgccacgcgcgccggaatcctcacctagagcgtgtctctttgatgggttggtcagttgatcggatgtgtctgtccgattagtgatcactgatgcgatgtggggccggatcgagccgctgatgtcggccgatccggtccgcggccggcggtgggccgaccaccgccgcacccttgaggccatcgcttggaagtaccgcacgagctcgccctggcgggacctgcccgacgagctcgggtcgttccagaccgctcacaaacgactgctcagatgggccgtcgacggcacctgggagaaaatcctcgcctccgtcctggcagcggcggacgccgacgacgacatcgactggaccgtgtcagtggactccacggtcgtccgggcccaccagcacgcggccggcgcacgcaaaagggggcggcccgctccggcgagccctccgatcacgcgctcggacgctcacgcggcgggctgagcaccaaggttcacctggccgcggacggtggggcacggccgctggcattcaccgtcaccgcaggccaggccggtgacgcacccgccttcgagacggtgatggcccgcatccgggtgccccgcacaggcacgggcaggccgcggacccgccccttcgtcgttctggccgaccgggcctactcctcccgagccatccgcagccacctgcgacgccggggcatccgcgcggtcatcccgcagccgtccgaccagatcggccaccgcctgcggcgaggccaccgaggcggccgcccgcctggctttgaccgagaggtctacaagcagcggaacacggtcgaacgctgcatcaaccggctcaagcagtggcgcggcctggccacacgaaccgacaagctcgccatcgcctaccaggccgcactccacctcgccggcatcctcatctggacccgacgctgaccaaagagacagaacctaggccgactcttccgggtcccgccgggccgggcccgccggagacgacctcggaccggccgtcaggacgcaggggctcgcccggacgtgtcgtgcgggcgagcccgtggtttcctcgcgccaggccgctacttgagcgcggagaaggccttggtgaaggccagcggctgctgcaggatcgaactgcacgtcgcgtcggcgtagccgaccgcgcccgccgcgcactgcttgtcccgggtggacgaccacatcgccagccggccgatccccttcgaggaggcgaagttcacgagctgggtggcgtcctccaccgtgaacacctcgctcgcgacgtcgttgacgccgatcatcggcgtgacggcgacggccttccacgccgccgcgtcggacagcccgagcacgcccttgatctgcgcctgcgtggccgtcgcggcctggatcgcgtactgccccatgtccccgctgtacgcgggcccgtagtccatcgccatgatgttgacggcgtcgacgcgcacaccgttcttcttggcgtcggccagcagcgccacacccggctgggtcaggccctcgggcatcacgggcagggtgaaggcgacgtccagacccgggtgggacttctgcagccgggcgatggcctgcgcacggcgcgcgttggcggcggtgtccggcagggccgcgccctcgatgtcgaagtcgaccttggtgagccggtactggtcgacgacctttccgtacgccgcggccagctcgtccacggtggcgcagttcagcgccagttcgtgaccggcggccccgccgaacgacacccgtacgtcgccgcccttggcgcgcagcgcaccgatctgcgcggcgaccttgtcgttcgcgagatccgtgacaccgccccacagcggtgcgcagccaccgccggaggtgatgaaggcgaggtggaactccttcacgcccgtgttcgtcgcggtgtcgagcaggtcgtaggcggggtacagggaggtgtccacgtacggggcgaagcgcgcgccgccgcccccgggcgccggggtgggggagggtgcggtcgccgtgggggagggcgccttggtcccggtgggggcggcggacgtggcgggcgaggtcggggccgggctcgccgtgacggtgggccgggcggtggggcgcccgctgggctgggccgtggcgccctggtccaccgagcacttcaccccgttgatcaggcacccggtggggttgccgagggtgccggtaccgctcgcgacgaaaccgacggtgacggaggcacccgccgccagctgcccgttccagctcgccggcttcacggtgacgcggcgaccggagaccgtgtgggtgccgttccagagcgaatcgatcttcgtgccctccggcaggtcgaactggagggtccagtccgactgcgccgtgccggtgctgttggtgatgacgtactggccggtgtaaccgccgctccaggagctggacttcgtgtacacggctccgacggaggtcgcctgcgcggtcccggtgaaagcgaaggccgccccaccgatcagcgccgccgtcacgatcgcgcccgtgaccttcgccgtacgactcgtgctgcgccggtgcccgactgtgctgcccatcgcgtgcctgcctctgtgttactggggagttggggaatccggcagcacgctagccgcaccgaaacggacattcgttcgtttcggcacggctctgatgagtcttaggttccgcttaaggcagggacaagcgggggatcaggaagcggcgttgtggagcccatccaccccaagggttccggctccccactgtccacggcagtccaggccgatccggcctgtgctgccgcgggcggctccccgattggctccccgaggacgggccgctcaccctcaggcgtcggggcgcttccatacgtcggggccgccgccctcccaggtgatcggcccgtcctcgctcaggtccacgtcctccaggccggcgcgacgcaggaactcggcaacgtccctcggcgtctgagcacgcccgaggtccgcgtccactccgagcgcatgaacggtgaccttccggccgcccttcggggataccggatgcacgatgatttccgtctggtccgacacgcccccagcctgccgtgccggcgccagtccagcacgccgagcgcgtaggccgtacccggcgcgccatccaggcgctgccgctctgagtcagccgccggcgggggaaggagtacgccagtgcgaccagcaccaggagcccccaccgcatcggaacgccggtcttggctgcggccgtcgacgcgtggcgatccccacccccgtggtcgcgatggttccttccgtccagagtggggctgacggtgatgccgactggaacgctttctcggcacggctgacaatgagaagagccagtccaggggcagtcattgacgccttcaacagctgacaggttgttgcaccatggaaatttggacggatctgggctttacgcagagtccctacaataccgattctctcccgccgacggcgataggggagaggctgcttgtggggcgagagagccatattcgccgcctgatcaatcgactgtcttcctcatcgagccatgtgactatcgaaggcgaggccggggtggggaagactagcctgatgaccgtggcgagctatcgcatgaagaggaatagcgacaagtctcgccttcccatcatgcttccagtcgatgagaaatttcagatcgccaccaaggggggcacgagcctccttgaggcaaaggtttaccgggcgatcgcggcggcatttattcagtatcacgatgacttgaaatcctggggatatcgcactccgaaggtgaaggagatcgataaatggatgaattcacctctcatggtgtcgatctctggaggcgtcaacttcgccggtttggggctctccgggggcaggggtgaatcctcgaactctgcatttgcggagtccggcctggccaacacggtccgcgcttgggtgaaagagtgcttcgacccgccaggatgcgggtacttcgtttgcgtcctggataatctggagcttctcgtcagctcggattcggcgcgacaggtgcttgaggaaattcgcgatacgattctcgccgagccgggcctgaggtggatagtctgcggggctcggggtgtagtgcgtacggcagtggcatcgccgcgactgcaaggtcgcctgtgtcagcccataaaggttgaacctctatccaaggatgatgcgataagagcccttgaggccaggattgaggagttttcgttgggtggatcgccgccggtcggcccggtcggctttcagtatctctatgaggtgctgagatgtaacctcagagacactcttcaggcctgcgaggatttcagcttctggctgcatgacgaaggaataatcggcgtgggggagagggagcatctggagctcttgcagtcctggttggcgcaggtgtcggacgagtacagtgcaagcgagggtgtttctgcggcgagttggaggctgttggacgacatggccgacaatggtggcgcttgccggttcgaagatttcgatctattcggattcggagaccgtgttgagatgaggcgatgtgcgaaagaacttgaggaaaacaacctgacgcagatttcgtcggatgacgcaggggcttttatggtctcctctggatggcttgcccggttctccagggccgggtacggggtccttcataattgaacaagcaatgatcccggggtaccgggatccagtcggccaccgccacagcgtgcctcgctggcatcccttcggccgtcgacccacacgtatatggagaccttggccatagaggcgcgcggccgacaccgtgtgcagtccctgctgccgcgctgtcggtcccaaggcctcgggcaggcctacgcgagccggagccaccgacgccgagcagcagcaggcggcgttcgggggttccggccggtcgttgctcccggaggaccttgtctttccgcaccccagcgggaagcttcgtacagcgcaggatgtccgacggaacttccgcggactccggccccggtgtggagttcgtggggtcagcggacggcgcggtagtagaccgggtggtccagggagtgcgtcaggccgccgtactggtcgacctcgatcggggccgcgccgggtgcggtgtcccggtcctgccccgtcccgccgtccaggaccacggacttctcgccctccgtctccgcgtacacggcgccgtgccagaacgccttgaccttcggcacgacccggcccgaggcgtcgggcagggcccaccgcttctgcaccgaggtggcgtcgaagaccacgatggcgcccttcgacgcggaaccgtacgtggaacacaggagcagcgaccgcgcgtcgtggcggcatccccagctcccggtgtcgaggaccgctcgctccgagccggtggcggcgtcgagcacgcgcgtcctgttctcccggtcggcggtcaccagtctcggcccggcggcggccggccgcgtcgcatcgcggaccgtccagcgggcctcgcccgtggcgagggccaccccgacgagccggcggtccccgtatccggcccgctcgcccccggccaccaccccgtcggccagtacgagggcacggaagtccggcttctgccaatgcaccgtgccaccggccgagtcgacggcgtaggtggtgtcgtccgcggtgaccaccaccacacccgcctcgaccccgatgacctgcggagcgaggacctcatccgcaccgatggcgcccgaggaccagccgtcgccccgcgggccggccgggaactcccccgaccacaccgtccggccgtcggccgtgtcgaccgcgaggacctcgatcaccttccgggacggggcggtcccctcgcccggcacggtcctgttccaggcggcgtacaccgtcttcttcccgcccgactcgaacacccgcggcgcgccgcggttgctgccgaaaccgcccttctccgccgcgttcttcgtccccaccgtccaacggggcttgcccgtctgcgtgtcggtggcctcaaggccggattcggcggtgacgtaggcgaccccgtcgacgagggtgaccgcggcccgcgtggcccctccgctcgccgtactcggctggctcgcacccggtagctcgaatccgcccgcttcgaacccgaccggcgggtcgaacgcctgccgcgcggacttcccgccatccgtctgcgacggcttcgccggatccccggacggcttcccctccgacgcgccgccgccttccccgcaggccgccagtccggcggtcgccagtaacacccccaccacgcccatcgcacggcgcggcaccctgttctccgaaagcatcacaactccccgttgacgtatcactactgctgatcacgaccatatgtccgaccgtcgtcccgcacgccctggtttcggcagcacggacgagcgaccgcgccccggcctcaggtcgcctggccgtgcgtggcgtcgatgacgcagaagcggttgccttcgggatcggccagcaccacgaaatccggatcctccgggtacgcgtcccagtcgacttgccgggcacccagagagaccagccgtgccacctccgcctcctgctcggccgcgtccgccgcgtacaggtcgaggtggacgcgcggccgttcctgtacgggtgtcacgctgcggccgagtgccagccccggcccgccgccgtcggccgggaccaggacggtccagccgtcgtccacctggccgtcgcggggtacgtaccccagcgcccggctccagaattccgcggcccgccgtacgtcagcggctcccatgacgatcgttccgagggtcagcatgatccgattctggcaaaccggcgcccgcccggtccggcccgcccggtccggcccgcccggcctacggggccgcgagccgctcgatcgcgaccatcgccgcgtcgtcgtccagggtgttgccggcggcgtgcgcgagcaggtcctggcagagccggtccaggagcgcgtgcgggggcaggcccgaccaggcgctcacgcgtcgcgccagcgggtagaacccgcccgcccggtcgcgggcctccaggacgccgtcggtgtagaggagcaggacgtcaccctcggcgaaggcgaaggtctgcgcggtgaccgccgacgcgacgaggccggcgagccccagcggtggcgccggccggtccgcctccagctgttcggcgccgccttcgcgcagcacgagcagcggcgggggatgcccgcagctgacgaggtgcagtaccggctcggcgtcggggatctccaggacggccgcggtcacgaagctctcgccctcgtcccctgcgccgtccaggtccgcggagaccgccgcctccaggtagtccaccaggcccggcagcccggccacctggtgggcggaggcccggaaggcgcccagcacgagcgcggcgtccccgaccgcctccagccccttgccccggacatcgccgatgatcagccgggtaccggtggccgtccgcgcggcggcgtacaggtcgccgccgatctgggcctccgccgcggcggccaggtacacggaggcgacacccagcgggccgatccggtcgggcagcggccgcaggaccacctcctgggcggtctccgccaccgaacgcagctgggtcagctccttctcgtgcacctctcgcaggtgggcgaagaaggtcacgaacaccgagatcatcacgagcgcgatgatctggaaggtgtggttcagatcggtcaggctggtgcgtgcggccgcgaccaccacctgcgccagtacggcgaccagaccgacgaagcccgtcatccagggccccgcgaacgacgccgtcacggccggtgcggcgaccaggaacggtccgaggtgcacgtcggggggagccagcacgtcgatcgtcgtcacaagggcgatcagcgcgaacgggaccgccagctgcgcgcggctcacctcgggggaccggtgatgacgtgggtacgacggcggccggagatccatccctcctgcatacaccgcgaggcgggcaggatccccgaagccaggccgtcacgggcacccgaccgtacctccggggtgaccgccgctcccagggcgcgacggccggtcctccggcccccggccggtcctcaggcgcggtggccgctcttcaggggcgacggcggggcttgccgcccttcgcgccctttccgcccttggggccgccggaggcgccacgggggttcttgcccgccgccggcctcccggaggacgacttcccggccccggacttcccggaccccgacttccgctgcgcgccgccaccgccaccggcaccgcccgtacccgtttccgggcgcttgcgcttggccttgggctgcggcggggtcggcgtgcgcccccgcgtgctgttcacggtccggccgcgcacgatcccgatgaactcctccaccaggtcggtggtctcctcctgcggccacgacagcgcgacccgcgaggcgggcgcgtccgagaccggccggtaggtcaggtccttgcggtggtgcaggcgggcgagcgactgcgggacgacgagtacgcccaccccggccgccaccagctcgatcgcgtccgccgtcgtcgcggggcgctcaatcgcgggcttgcccggcagctgctcccaggccagggtgtcgtcgagcgggtggaacacgatctcgtcggcgagatcctcggtggacacctcttccgccgcggccacgaggtggtccttgggaaccacgaccaccgtggtctcggtgtagagggggatcgcgctcagatcgtcacggtcgaccggcagccgcacgaacccggcgtcggcgccgcccgcccgcagcacgccgaacgcctcggtcggggacaccgcgaccagggtcagcgggacgtcgggcagccgctcgttccagatacgcacccacttgctgggtgtcacccccgggacataagcgagccggaacgaatggggtacttccgagcctgtcaccccgcaaggttaccggtcgtggtcggaggtagcgcacacgctcgatactcttgacaccatgacgtcgcaccagaacacccagacgatgaagcccgcgaccgcggcgaagaagctgggcgtgtacctcgaggccacccccgcagagttccaggagggtgtcgtctcgcgcagtgaattgagtgcgctccaggccgatccgccccagtggctgcaggacctgcgcgccaacggtccgcacccccgtccggtggtggcggccaagctcggcgtctccatcgccggcctcgcccgcggcggggtcaccgagcccctcaccacggagcagatcgaggcgctgaagcaggaagcccccgagtggctccagcgtgagcgcaccacccaggccgaggtccgcaaggagacggtccgcatcaaggagaagaacgcggagcgggccgcgaaggcccgtgagcagcactcctgacccgcgcctccgctttccgtcaggcctggcttccccgtggggaggccaggcctgacgccttccccggccctcccgccgtcccgctctcccgcgtccctgcgcccgcggggcccggccggatcacccggcagccccgtctcctcccagcagccgcaccgcccggtcgagccgggcccgcctggtctccggtgtgagcgcctggagcagcggcaggatcacctggtagcgcccggtgcgatcgagctcctcgaacgccgctgccgcctccgggttcgcggcgaaggccgccgcgagatccggtggcaccgccgccgtccgctgcgactcgtaggcgtgcgtccaccgcccgtcctcctgcgccctgcgcacctcggcgagcccgggctcgcgcatccgccccgcggccgtcagctccgcgaccttgtccacgttcacccgtgaccacaggctcctggcccggcgcggtacgtacttctgcaggtagtaccgctcgtcgagggcgcgccgctgcccggagacccagccgaagcacagcccgatgtcgaccagctcgtcatcggtgaccgacgcgatcccggacttcttcttggccagcttgatccacacgccctcgtgccgcgtgtggtgctcggccagccagccctcgaacgccccggcgtccgcgaaggcgatgatctccaccccgcccagttcctccatgcgcccaggctaacgcccgccgtccgggccggacggggccgacacggcccgcgaaccggcgcgcagttcgcccagcaccacctccaacgtgggcctgcgggcgtcgagttcgaggatcgcgctcccgtcctcggccgcgaggtcaccggtgatcgcgaccgtacggccccggggcgtaagcccgggggacgatgcccggtcgggggcggctggctacggtcatgccatggacaacccaccgcagcacgagacgaccgcgagggtcgcgaacgccgacagagccacggaggccgacaaggccgcggaggcgccgaacgtctcgcatgcgccgaacaccgagcacgtcaagcggagttcgtcacgggtgcccggctccgcccgcgcggcctggggcggtgcgctcctctacgccctcgtcccgggcctgctgatcggcggggtcccggacgccgccggaccgctcctcgggatcgtgctgctgctggccgtgaccccgctcgtcccgctgctgcggtaccggcccctggtggcactgaccctgaccctcctcggcggcacgctcgtcgcgggagccgcccgggaccacggcccgggccggttcctcgtcttcctcgcctcggacctcgtcctcggatgcatcgtcgccacgcgaccccggcgggacgcggccatcgccctcgtcatggtgttcgccgtggagcttccggcggtcgggctgttctcgatcggaccgtacgacctgatgagtacgggcctgatcgccttcctgtcgctcggcgccgtctgcatgaccggcctgcggttccgcgagcgccgcgagcacgcggccgaacggcgcacacggcaggtggccgaggccgtgaccgccgaacggctgcgcatcgcacgcgagttgcacgacatggtcgcccacagcatcggagtgatcgccatccaggcgggtgtcggcagccgggtcatcgacacccagccggacgaggcccgcgccgccctgcgggccatcgaggccaccagccgcgaaaccctgtccgggcttcgccgcacactcgtcgcgctgcgccgggcgcagccggacggccccgaggggcaggcgccgctcgggcccgcgcccggactcgccgaactcgacgggctcgtggccaccaccgccgacgccggagtgcgggtcgacgtacggtgggagggggagagccgtcggcttccgcccgagacggacctgtcggcgtaccgcatcgtgcaggaggcgctgaccaacgtggtccgccacgcggacaccgggcactgccgggtcaccatcggatacggggaacaggagctgaccgtggaggtcgtcgacgacgggcgcggcacgcccgacggcatcgggagtacgggattcggcctcacgggcatgcgcgagcgggtcagcctgctgcacggccgtttcagcgccggcccccgggccgggggcggcttccgggtcgaggcggcgctgccgctgcccctcgccgcaccggccgtgggcgggctccgatgaccgtggctcccgcgcgggcgatccgcgtcctgctcgtggacgaccagccgctggtcaggtccggcctgcgggtgctgatggccgacaccaccgacctggaggtcgtgggcgaggccggtacgggcaccgaaggcgtccgcctcgccgccgaactgcgccccgacgtggtggtgatggacatccgcatgccgggcatggacggcatcgaggcgacccggctgatcaccgcggggacggcggcggtcagggtgctcgtgctgaccaccttcgacgaggacgaccacgtctacggggcgctgcgcgccggcgcgagcggattcgccgtgaaggacatggccgtggaggagatcctcgcagcgatccgggtgctcgccgcgggggacgccctgatcgcgccgggcgtcacccgcaggctgatcgcggacttcgtccggacgcccggacccgcggcacccgaggcgcgggcgccgcggtccgtcgagggcatcaccgagcgcgaacgggaggtcctgacgctggtggggcggggtcgttcgaacggcgagatagccgaggagctgttcatctcggcggccacggccaaatcgcacgtctcgcgcctgttcaccaagctcggcgcccgggaccgggtccagctcgtcatcatggcctatgagatgggcctggtcgcaccgccccgttgagggcccgggcgccgggacgcgatcggcgccgacgcgcacggtgctgacgcgcacggtgctgacacccgtggtgctgacccgcgcggtgctgaatcgttttctcaggcggtcacggcctccgggcggttctcgtcccgccgcccggcggaggccgccgccgaacgcgaggagaacaacccgtccaccgccagggcgccggggccggtgaacaccagcaggaggaaggcccagcagaacatcgccgaggcctcgccaccgttctgcagcggccacagcgcgtccggctggtgcacggtgaagtacgcgtacgccatcgagccggaggcgacgaaagcggccgcccgggtgccgagacccagcaggatcagggcgccggcgacgagctggatggccgcggcgtaccagccgggccaggtgccggcggcgatggttccgccaccgtgcgcaccgccgaggacaccgaagagggaagcggcaccgtgcgaggcgaagagcagtccggtgacgatccggaacagcccgacggcgtagggctgggcatggtggagacgtacgttcatggggggaggctccttcggtcggggacggatcccgaagtcgtgccgaggttcttgagcgtgggcgagccataggttaggtagccctaaccgggctgacaagcgcgagttccggccacccaccggggcgttcgacgccccgagccaccccgctcggggcgcggcggggcgggtcggcgcgcccgcgcgagggaccggggacccgccgccgcgcacccttgtgacggaccggcaggcccgcatccccgcccgcgcatcgcgcgctggttcgcccggttccgcgtgcggcgggtgtggcgtccgggcgtgtggttcgtccggcgggtcggccccgtccgctggcagccggccggccggtggggtccgctggacgcgtgagcatcctccccggccgcgactggtggaccgggctcccgcccgcggcgggagccgcggtcatggccaccggcatcatctccgtcggcctgcacctgaccgggcacgagccggcgtcgctggccgcgctggtcgtcgccggggcgctgtggctggtactcgccgccgatttcacctcccggctgctcggcgaccgcggaaggttccgcgccgaggccgacaccccggccgcgctgacggccgtcgccgccaccaccgtcatcggggcccggctctcgcagcagggcctgcagacggcggccgccgcactgctcgtgctggcggcggtgctctggcccgggctgctgttcaacgtcctgcggcactggcggcggcgcatgccgggcgcggctttcctcggctgtgtggcgacccaggggctctccctcctcgccgcgtccctcgccgacgccggccaccgcgacccgctggcgtgggcggccatggccgccttctgcctcggcctgatgctctacctggcggccctcttccgcttcgacctgcgcgaggtggtcggcggtgcgggtgaccactgggtggcgggcggcgcgctctccatctccgccctggccggatccaggctcatggcgtcacccgtatgggccggagccgcgcacggcgttctgcgcaccgtcaccctggccctgctcgccctgtccctcgtctggtacgtcgtcctcctcgccgccgaactgcgccacccgaggccgcgctacgacatccggcgctgggccaccgtcttcccgctcggcatgaccgccaccgcctgcctctccgtggcggccccggccggcatcgcccggctgcgcacactcggcgaggtactgctctggatcgccgtgggcgcctggctgctgaccttcgccgcactggtcgcctcgcacctcaccgccgggcgcggaccggtggcccgatgacgcccccgcgcccgcaccgtggcaccggaccgctcgccgctcgccggcaccggaccgctcgccggccccgcccggccggcgggacaccgcctaagctgcccttcgtgaacgtcatcctcttcggcgcgaccggcatgctcggccgcggcgtcctgcgcgcatgcctgcgcgacgactcggtcgagagcgtcctcgccgtcggacgcaccccgctcggcgtcagccaccccaagctgcgcgagtgcgtccaggacgacccgtcggacctggccgccgccgggatcgacccggccgcccacgacgcctgcttcttctgcctcggggtctcctcggtcggcatgaaggaggaggcctaccggcgcgtcacccacgacctgaccctcgccgtggcccggccgctggccgccgccaatcccggtatcaccttcgtctacgtctccggcgagggcaccgacagcaccgagcggggccgttccatgtgggcccgggtcaaggggaagaccgagaacgacctgctggaactccctttccgcgcctacatgttccgccccggcatcgtccagcccgtgcgcggggtgccctccaaggcccgtatctcccggatgttctacgcggtcctcggccccctggtccccctcgtacggcgggtcgccccgaacctcgtcatcacctccgagaccttcggccgcgccatgatcgccgtcgccacgcccggcaccgaggtccccggccacatcctgcggcccgccgacatcaaccgcctgggtggtgcgccgaccaggcataattgactaccgggcacaccctcccgcacgtgagaatgagccatctcaaaccgggaggaccccatgagccaggagaccctgactctgcatgacctgctgcccgcacaggcgctggcggactcgatcgacgccgggtacgtgacccgcaagtcgcaccccgaactgccgctgtccatctacacctacacacggacggcccagtacgaacgcgtctggaacgacgtcaccacgcgctgccgcggactcgtcgccgacgacaccaccggcgcgatcgtcgccctgccgctgccgaagttcttcaacgtcggcgagcacgagtcgggtcagccgtacgcccccgccctcccggacgagccgttcgaggtctacgacaaggtcgacggcagcctcgccgtcgtcttccactacgccgaccgctggcgggtcgcctccaaggggtccttcatcagcgcccaggcgacctgggcgcagcgcacgctcgacggcagggacaccgcggccctgcgccccggcaccacctacctcgccgagatcctgtacccgcagaaccgcatcgtcgtcgactacggcgaccgccgggacctcgtcctcctcgccgccttcggacaggacggcaccgaggtcccgctcgccgaggccgcgtcccactgggaggggatcggctccgtcgtcacggtgtggccggccatgcccatcgacgacctgatcgcgctgaccgactccaacaccctgcccgggggcgcccgggcgaccggcacccaggcggagggcttcgtcctgcgcttcgcctccggtgtgcgcgccaaggccaagctgtccgagtacgtacgcctccaccggctgctcaccaaggccaccgagcgggacatctggcgcgcccacggcatccagcggttcgccggcctgcccctcaagcagctggcccagggcctcggcaccacggtcgccgagatcgaggcctcgggcggcaagcccctcgacgcgctgctggaccaggtgcccgacgagttcgacacgtgggtgcgcgaggtgatcgagcggatcgagagcgagttcgcgcggcgcgagcgcgccatcgacgaggcgtacgcgggcctcgcgcacctggccgccgaccggggcgccttcgcccgggcggtgaagacactgcccgaccgggaggtcagggccgcgatgttcctgcgcctggacggccggtccacggaactggccgtatggcgcaacgtgcggccggagacgtccgaccccttcacgaacgacgaggagaactgacccgtgtccgaagagacacccacgcatacggatgcggatgacgacgtgaacgcggccggggccgtggccgccgccgaggaggccccgctgcccgtcgtgcacgtcatgacgggcctgccggcctccggcaagacgacggccgcgcgcgccctgcaggccgaggccggtggccgcatgcgccgcgtcaacctcgacgacctgcggctcatgctcgacctcccggacccggcacggggccgcagcttccggcacgagcagaccgtgctggccgtccaggacgcggcggtccgcgcggcggtcgacggcggtttcgacgtggtcgtcgacaacacccacctgaccaagaacatccccaagcggctcaaggcggcggtcggcggtctcgcgaccttcgtcgtccacgacttcaccgacgtcccgctggaggagtgcctgcgccgggacgccgcgcgcgagcgccaggtcggcgaggagatcatccgcatcctggccgagaagcacgagaaggcacgcaggggaggctggcggctgacgtcggcgtggatgaacggcgggtcgagcggggtggccgcgccgcccgtgaccgcgtacgttcccgacccggccctgccggcggcggtcatgtgcgacatcgacggcacgctcgcgctgaccggcgaccggggcccgtacgacttctcgcgctgcgagctcgacctgctcaacgagccggtacggcacgcgctcgacgccttccgccgcgcagacggcgacgtgatcgtgctgctgtcggggcgcggcgaggagcaccgcccgcagacggaatcctggctgcggcgccacgaggtgccgtacgacgagctgtggatgcgcgcggcgggcgacacacgccgcgacgacgtggtgaaggcggagctgttcgacacgcacgtccgccaccggtacgcggtacgggtctcgctcgacgaccgggaccgggtggtcgcgatctggcgccggatgggcctgcccacctggcaggtcaactacggagacttctgaggccgggctgccgtggacgcggtgaacgccgaggacgctccggacgccgtgcggaacgtgctgatcgtggacggtgcgaacgtcgtcggctcggtgccggacggctggtggcgggaccggcggggcgccgcggtccggctgcgcgacctgctggccggccggggcggggacgaggagatcgtactcgtcgtcgagggtgccgcgcggggcgtcgggtccgttcccggcgtccgggtggactcggcgcccgggagcggtgacgaccggatcgtggagctggccgccgcatacgcggagcgcggctgcgtcgtggtcacggccgaccgtgaactgcgggagcgggtccgggcgtacggcgtcgagtgcgtggggccgcgtgccgtacgcccggtgaactgaccgctcagcggcagtacttcacctcggagaggttcttgacgtagcgcgcggagacccagcgctccttgtcgtacgcgcgcttgggcgcctcggcgtcgtgctcccagctgctgttcctgtcggccaggcggtaccagatgccgttgccgtcgaccttctcaccgtacttcttgcactcgatctcgaccttgctgttcgggtacacgtggccgagggactgcgagtgggtgctcggcttgctgcggaccgtcagcgggcccttcgacacgaccttgccggtgacgtgcttcttttcggggtacgcgccgggctcctgggaccctccgccgacgacgatctcccgcggcggccggttctccggaccgtcgtcggccacggcggcgcccgctccggccagaccgagaaccaggctgccggtggcgagagcgagggtggttctggtgggcttcagcatgagccggctcctctacgaagacatccacccggccgcggcgtgcggcgcggggctgcaaccaggcggttgccagggacgactatgacgagggcggggcgcgtagccccggtggctcaccgtcctttaacccgatatgaccaatttgtctattggagtgcgaggctgtgcccccctgaccgcccggccccggatgcgggcggtggcggcccgagcgagagtgggagccatgggtatcgatgactacggcggtggccccggcgcacacgagagcggcgtcctcgtcgtgacgaccaacgacgtccccggctaccgggtcgaacgggtcatcggtgaggtcttcggcctcaccgtccgttcccggcacctgggcagccagatcggcgcgggcctgaagtccatgatcggcggcgagctgaagggcctcaccaagaccctggtggagacccggaaccaggccatggaccggctcatcgagcaggcgaaggcgcgcggcggcaacgccgtgctgatgatgcgcttcgacgtcaccgacgcgcaggacgtcgggaccgaggtgtgcgcgtacggaacggccgtcgtcctcgttcccgcctccacctgagccgcccgacccgccgggccttcggccggcccctgatgcgatgctcggtccatgacggatcgacacgaggttgtcatcgccggccggccgggccgggcgctccgcgccggggacgggctggccgggctgctggccgcctaccacctgcggacagaggccgagaagggtgcggccgtcgccggggtggacggcctgccggaccgctaccggatggagatcgcggacccgcggaccgcgttcgccggtgacatggtgctgctggcgctgagcggggacaccgcggtgggctgcctggtggtgaccgccccggccgggggacggtccgaggtcaagcggctctggacggccccggagttccgcggaacgggcatcgcctcccgcctcgtcggcgccgcgctcacccatgcgggggaaagcggcgccgacgtggtgcggctgtcggtgtgggactggcggacgggcgcgatcgcgctgtacgaacggctcggcttcaccgtcaccgagtcgtgggacgagcgggaccggctggtctgcatggaacgggccgtgtgaggccgcggcctcacacggcgggctgcgactaccgcttccagagggtcacttcggtgaggtacgtcggcaccgtggggtgggccccttgctcttgccgaacgaggtcgaggtccggatcccgtcgtaccccatcgtcagctcctggtccgacggagcctaacggggggcgtggcccccaccgcaccgcgccactacggtggtgctccggagacgaaggggcggcccgatgagtcaacgcaagtcggcggcagaggtgttcgacgagctgggggagcgctacgaggaggtgttcgggcgggttcccggccaactggcggcccttgactggctcaccggccgactgccctccggagcacgggtgttggacgtgggcagcggtaccggacggcccaccgccgaggcactggtccgggccggatgcgccgtcaccggtatcgacgtctcggcggccatggtcgaactggcccgcgccagagtcccgcaggcccgcttcgagcaggccgacgtacgcacctacacgcccgagcgggccggcttcgacgcggtgtgctccttcttcccgctgctcgtgatggaccagccggaggtcgcggaggcgctggactgcatggcgtcctgggtggcgccgggcgggtacttcgtgctggccacggtgccgggggacatccgcggcctggacatcgagtggatgggccacgaggtcaccgtcagcagcctctccacggaggaccacctggccaggctcgccggcctcggcatggaggtgctgcaccaccacaccgcacccttccggccggccgatgaccgggcgggccccgaggagcacctcttctgctacgcccgccgcagcgtgtgaagcccgtaccgaccgccgggcgccctcagggggacgcgggtgcccggccgtcggtacgcgacgcccgcgcgcccggccccggcgtccggtcgggccgcaggcccgcggccagccccgcgatcaccaccagcaggcccagccacaccgcggggcccgggaccccgctgcccgtgacgacccccgcaccggccgcggccaggggcgcgaccccggtcagcaggccggcgcgcccggcgcccacggcggccaccgtgcggtaccagaggaggaaggccaccgccgtcaccatgacggcgaggtatccggccgccacccactggggccgcccgagcgacgcgaccgcggccgggctctcgaagacgaccgtgagccccgtcagcatcagcgcgcccagccacaccgcgtgcacggacaccccccacgccccgtgccggcgcagcaccggcaccgcgagcagggtgaaagcggcctcgcagcccagtgcgagggccgcccaggccacccccgccgcgtccgtccggcccgttccctcgaccagtaccgcccccgccaccaccaccggagccgcgagcagcacccgacggctgggccgccgcccttccaggaagggaccgagcagccccagcaggatcggcacggaggccaccgcgacggcgatgacggccggttcggcgtgcgccaccccgcggaccacggccacgttgaacagcaccagcccggtcgccgcgatccccgccagccacagccactcccggccgcgcggccggtggagcggcacccgggcggcccgggccagggcgaacagcagcagtgcggcagccgcgtagcggacggcctgggtggcgaacagcggggcgtcggcgagcgcccgcgagaccgtgacgctgctgccgaccagggccattccggcgatccccggaaccagatcccggaacgccgtggagccggcggtggcagcggaggcggtcgtggcggaggcggtcggagcggtgacggtcgtgagggcggttccggagccggattcggtggtggaagcgggtggtgtctgcatggcattcagcgtgtccgcacaatggccccatgagcaggtccaatgatgatgcctccgaggggtccaaaagcccgagcggctcggacttcctccagctcgacgtaggccaggccccgccgggcggccgcaccgaatggctggcggggcggctgcgggccgccatcgccgacggcaccctcccggtcggcagcaggctcccggccagccgggtcctcgccgccgaactgcgcgtctcccgggggctcgtcaccgaggcctaccagcgcctcgccgagaccggccaggtcagcggccggggccggggcggcaccgtggtcgtcgccgccccggccccggtggccgccccctccaccgccccggcgcgcggcgggctggtggacgccctgcgcgccgtaccgtgccggatcgacctctcgcccggcgtcccggacctcgcggccttcccgcgcaccgcctggctgcaggccgagcggcgcgtcctctccgccctcaccccggccgacttcggctacgggaacccccagggcgcgtcagcgctccgggaggcggtcgtcggctggctggcccggaaccgggggatccgagccgaccccgccgaggtggtcgtcgtcgggggtgtggcccaggcgctggcgctgctggcgcacgtgctgcgggaggagggcggcgtgcaccgggtcgcggtcgaggaccccggctcgctcggagcccggcagcaactggagtacgggcggatggagacggtccccgtaccggtcgacgaggctggtctggacgtggccgcgctgcgggcgagcggggccggagccgtcctgctcaccccggcgcaccagttcccgaccggcgtcgtcctcgacggtgagcgccgccgggacctgctcggctgggcggccgccgggggactggtcatcgaggacgactacgacgccgagcaccgctacgaccgggcgcccgtccccgccctgcgcgccctgctccccgagggcgtctgctacgcgggaagcgtgtccaagctcctcgcccccgcactgcgcctgggctggctgctggtcccgccgcgcctgctcgacgccgtgaccgccgccaagcgctacgccgacctcggcaatccggtcctcgcccagctggtcctcgcgcggctgatggactcgggcgagctggaacggcacctgcgccacgtccggcgccgccaccgccgtcgccgcgacgccatgctccgggcggtcgccgagctgctgcccggcgcccgggtgcacggcgcggcggccgggctgcacctgatggtcaccttcgacggtgcgggcttcgaggacacggccctggcctcggcggccctggccctgggggtcaagacccatccgctgtcctggcaccgggtccggccagggccgccgggtctgatcctcggctacgcggccggctcggccggagagatcgaggagggcatcgccaccctggccacggccctggcgggggtggacgcgctgccggaaaccggccggaaagtttttccggaacggcggcaacctcccggggggtcgcgcgtcgtgcgggggtgaagggcgcagtaccgcgtcctcgacccgaccgtggagaacctccgtgaagaacctgtcgcgtgtccccctggccttctgccggacggccgtcaccgctgccgtcaccgctgccgccgccggagcggccgtcgctctcgccggtccggccttcgccgcgagcagtggcccggccgccgcgccctccccgtcggtcagcgcgcccgccagtgcctcgcccagcgcgggcgcggtcaagccctccccgtcggtgagcaccccgccgagcgcgtcccccagcgcgtcccccagcgcgtcccccagtgccgcgcccagcgccgttccgtcgtccccgggttcgagcgccaggcccagcgcgtcgccctccgaacccgccgtcgcaccgggcggggccgagctcgcgcatactggctcctcggcgacgaccatcgccatgggggcgggggccacggttctggtcctcgccggcgcgggagccctgtacgccgtgcggcgccgcgcgaacagctgaggaatcccgtgctccaactcgcctcacccgtcggccccctcacgcccggcttcggccgggcgtgggggggcctccggtcgttgctgcgccgggagcggcacgctccgccggtcaccccgcggccgtacacggacccgtacggctccccgcacacgtacgacctcccgggccacggcgaccagcggccgcccaccgtcaccgagctctactacgcgcaccggctgcgcatggtccggctggcggtgctgctggtcgacgacctggccaccgccgaggacgtggtccaggacgccttcaccgccctctaccggcggcacggggagcagatagccgaggtcgacaacgcgctgggctacctgcgtaccgcggtggtcaacacctcgcgctcggtgctgcgccgccgccgcaccgtccgggcctggaccccgccgaccgcggccgacatcccgtccgccgaggaccacgtggtcctggacgaggcgcaccgcgaggtgctcgccgcactcggccggctcacgccgcgccgccgccaggtactggtgctgcgctactgggccgacctcagcgaagcggagatcgcggccaccctcgggatcagccggggagcggtgaagtccaacgcgagccgcggcctggacgccctggaacggattctggagggacggatatgacgcgtgacggcgaacgcctcaccgagcgccccgtcgagcgcaggctgcggcaggccctcgacgcgcgcgcggacagcatcgacgtccgccggctgcggcccgcgcaaccgccgggggcgcaccggggacggctgccgatggccggcctgcggcggttcgcgctgccactggcgggcctggcggcggccgcggcggtcgccgggatcggctacctgctgctcgccccggacccgtcgccgcccggccccggactgccggcgaacccgccgcggatcacggcccccggcccgtccccgcgggacccgacgtcacccgccccgcagccttccgcgtccgggcggcagaccccttccgtgtcctcgcccccgagcgggtcggcgagcccgtcggtccccgtctcacccagggcgtcggggtcgcagtccccgtcgccgagcccgtccggcgcccgggccgccgtgtcgtcctcgccgcccccgccgagccccgctccgcgctaggccgtgtccgcggcggcgggttcagccccggaggttctccaccgccgcgaccagcggcgcgagttccggtgtgtgcgaggcctcgtccagggcctcgcgcagggcggtgtcgttggtggggcgggccgcggccagcagggccaggcccgcctcgctcacgtcggtgtagatgccccgccggtcggtgtcgcagatgtagcggttcagcaggccgcggtcctccagcctgctcaccagccgggtcgtcgcgctctggctgagcaccaccgagtcggcgacctggtgcatccgcaggtgcccgccggggccgttgtgctggcggctgaggacgtcgagcagcgagtactcgcgcacgctgaggccgtggccggcctgcagggcccgttcgatgtgcgcctcgatccgcccgtgcaggagggagagggcgcaccagccctgggagagggcggtgagcgcgctgtccgtggccgtcatgggctcctccatcgaagcgtcccgggctggggtctgtgaccaccaggatagtccacatccgcaatagcccgcgcttgcaaatatcccgcgtctgcaattaatgtggacgcatgcaagcggcgaccgcatgcaatcgcccccgatcgcgatcgaagccgtcgtcccgccgcacccgcaccaccccctcccctgaaggacacctcccccatgcctctcgcactcctcgccctcgccgtcggggccttcgggatcggcaccaccgaattcgtgatcatgggcctgctccccgaggtcgccggtacgtacggcgtctcgatccccgtcgcgggcttcctggtcaccggctacgccctcggcgtcgtcctcggcgcgcccctcatgaccgtgctcggcacgcgcgttccccgcaagcgcatgctgatgctgctcatgggcctgttcatcgcgggcaacgtactctcggccctcgcccccgccttcggcgtcatgctcgcgggccgcgtcgtcgcctcactcgcccacggcgccttcttcggcatcggcgcggtcgtggccgccgaactcgtcgcccccgagaagaaggccggcgcgatcgccatgatgttcacggggctgacggtggccaacgtcatcggtgtcccgctcggcaccttcgtcgggcagaccctcggctggcgcgtcaccttcctgatcgtcgccgcgctcggtgtcgccggtctgctcggcatcgcccggctggtacccgagctgccccgtcccgagggcggggtacggatccgccgcgagctcgcctccttccgcaacgtccaggtgctgctcgcgatggcgatgaccgtcctcggcttcggcggcgtcttcgccgcgatcacctacatcaccccgatgatgaccgacgtggccggcttcgccgacacctccgtcacctggctcctcgtcctcttcggcctcggcatggtcgccggcaacctcatcggcggccggtacgccgaccgcgcgctcatgccgatgctgtacgtggccctgggcgccctggccgtcaccctcgccgtcttcaccctcacggcccacaccaaggccggcgccgccgtcaccctcgtactgatcggcgccctcggcttcgccaccgtgccgccgctccagaagcgcgtcctggaccaggccgcaggcgcgcccaccctggcctcggccgtcaacatcggcgccttcaacctcggcaacgccctcgccgcctggctcggcggactcgtgatcgccgccggcctcggctggaccgcccccaactgggtcggcgcggcactggccgcctccgccctggcgctcgccctcgtctccggcgcactggaacgccgtacggcgctgcgcgcggcccccagcgaccggggcaccgtcgtggcggctggaacacccggggcgaccgagcccgtccccgcccaccactgaaccgcccccttccgcctgcccccttccgcctgccccaccgcaaggagaaacaccgcatgcccacgcccaccgccacccgcgccgccgtcgttcccctgaccaccgaggacgccgagctgctcgtcgccaccgccacggccgccgccgaagctgccggggtcacggtcagcgtcaccgtcctcgacgccggcggccacctgctcgccttccgccgcgacgaccgcgccgtcctgatcagcggcgagaccagcacccgcaaggccttcaccgcgctccagctgaacgcccccaccgccgacctggtcgaagccgtccagcccggcgcccccttccacaccctgcccacggccctcgaccggcccctgctgttcatcgccggcgggctgcccgtccaccgcgacggccgtctcatcggggccatcggtgtcggcggcggcgcccccgaccaggaccacggcttcgccaccgccgcgcgggacgccctcggctgagacctccgggtcgcgcgcccgtgtcccccgtgccacgttggtacgggggacacgggcacatgatgagcacaccgagacggcacaagagggtccgcgcgagcgtgacggctgcggtcgccgcgctggtcacccttgccctccccggctgcacggccgcctcggacgaggcgcgcgcccccggtgccccggacgcctccgcccaggcctcttccgccagagcggccggccgggccgaggccgcccccacccccacccccacgccgaccccgtcctaccccctgtccaccgccccgcgcaccatcccggcggtacgggagcacgtgcccgcccgcggccccggctggaagcccacccccgacgcccgcgtggtcgtcgccccggacgacaccgccgccctctccgacgaggcccgactgctcgccggtgagctgaacatcggatacggcgcggcggcggcgccgcgcgccggcgacgtccagctgtccctggacgccggggccgggggagggcccgagtcgtacaccctcgacgtcaaggacggccgcgtccggatcaacggcccggaccaggccggggtcttctacgggacccgcaccctcaagcaggcggtcaagagcgcaggttcggcccccgagggcaccgtgcgcgacgcacccgccaaaccgcagcgcggcctcaacctcgacatagcccgcaagcccttcaccgccgactggatcgaggaccggctgcgcgagatggccgacctcaagctcaaccagctcggcctgcacttctccgacgaccaggccttccgcatccagtccgacacgcaccccgagatcgtctccaccccgcacctcaccaaggcccaggtccgggagatcaacgcgctcgcctcccggctgcacatcacggtggttcccgagatcgactcgcccggccacctcggcgcggtcctgcgcgcccaccccgacctgcagctgcgcgacacgcagggacgggcggtgaagggggccgtggacatatccaacccggcctccgccaagctggtggacgagctgctgcgcgagtacatcccgctcttccccggcggagcctggcacctgggcgccgacgagtaccaggcactggtctaccgcgacccgcaggcctccttcccccagctcgcccgcgccgcccagcagcggtacgggccctcggcgcgggtccaggacctggcgacgggctggctgaacgaccgcgccgacgtggtccggccgtcgggcaaggcgctgaaggcgtggaacgacgggttcttcgcgggcggagtgaccagcgcggccaaggacatccaggtcgagtactggaccggcaaggagaacggcgcccggccgccgctggagtacctgcgcgagggccgcaagctcgtcaacctcaacgacgagttcctctactacgtgctgggggagcccaaccagttcacgtaccccaccgggaagcggatctacgaacagtggaccccgctcgtactgcgcggcacgacccccgtcccggcctcctacgggccgcagatcctcggcgggcgcctcgccgtctggagcgacctgtccggcgcccagacgcaggcccaggtggccgcgggcatccaggccccgctggccgcgctctcccagaaggtgtgggacgcgcgcaccccccagctgccctggtccgaattcaaggcccttgccgaccggctctgaccggtcacggatcttcccggtcgcggatggtcacggatcttcccgggggccggcgaggtgccgtgccgggcgggccgggcccggcaagatccggaagagacggcctagagcgtgtctctttgatgggttggtcagttgatcggatgtgtctgtccgattagtgatcactgatgcgatgtggggccggatcgagccgctgatgccggccgatccggtccgcggccggcggtgggccgaccaccgccgcacccttgaggccatcgcttggaagtaccgcacgagctcgccctggcgggacctgcccgacgagctcgggtcgttccagaccgctcacaaacgactgctcagatgggccgtcgacggcacctgggagaaaatcctcgcctccgtcctggcagcggcggacgccgacgacgacatcgactggaccgtgtcagtggactccacggtcgtccgggcccaccagcacgcggccggcgcacgcaaaagggggcggcccgctccggcgagccctccgatcacgcgctcggacgctcacgcggcgggctgagcaccaaggttcacctggccgcggacggtggggcacggccgctggcattcaccgtcaccgcaggccaggccggtgacgcacccgccttcgagacggtgatggcccgcatccgggtgccccgcacaggcacgggcaggccgcggacccgccccttcgtcgttctggccgaccgggcctactcctcccgagccatccgcagccacctgcgacgccggggcatccgcgcggtcatcccgcagccgtccgaccagatcggccaccgcctgcggcgaggccaccgaggcggccgcccgcctggctttgaccgagaggtctacaagcagcggaacacggtcgaacgctgcatcaaccggctcaagcagtggcgcggcctggccacacgaaccgacaagctcgccatcgcctaccaggccgcactccacctcgccggcatcctcatctggacccgacgctgaccaaagagacagaacctagggccgccccgtacgggcggcacgctgccgacggcgccgcagccactggccggccagcggcagcgccaggagcaccgccgccgtccagacggcggcgaagacccagatcaggagccgggagacggtgacggaagccgccacgaacagcaccgccgccaccacaccgagcagccaggcggccacggtgcggtgacggcggtgggacgtggaccgcaggatccggtcgagggaacggtcacccttgagttcggcctcgatcgcggagagggcgcgctgctcgcgatcggagagtccggctccgtccatcacgacgtacctccgacgactgctgccgtcgggcgcgggtcgcagccgctggcctgggaataccctgcctgacgcggcccaacccccggagggcgccgtgactgcgggacccggtcaccagatggagtcgacccactccgggtggtcgatgaacgggttgcggttgtgctggtactggtcgaatatgacctggttgcggcgctgctcgaaggcgtccggcgggtccatctggttccactgcttcagcaggctgatccggcccatcgcgggagccgaaccgttgttgaccttgtcgttcggctccaggtcggcgaagccgtcgcctccgtcgtagcggacggccatgtacagcagcatccgggccacgtcgcccttgaccgcgtcgcgcggctcgaaggagtcggcgtcggtcaggctgcccggcgcctcgctgacggggctgccgcccttgtcgaagtccttgttgccccgggtgctgttgacggtgacgtcctcggggcgcaggtggtgcaggtcggtgccggggccggtggcggtgccgaagtcgccgtggctcttggcccagacgtgctcgcggttccagtcgttgaccccaccgccgttcgtcgacttggactgggagcggccggagtagaccaggatgacgttgttggggttcgccgggtcctggtcggtcaccttcagggcgttccacacgccgtcgtaggtcaccttggactgggtcttgatgatgttgtgcagggcggtcttcagggcgggcccggtcttgccctgggcgctcgcgtagtagtccgcgtacgggtccgcagcggcggccgtcgcgtcctcggttgcggtcgtgcgccgctgtccggcggacgcggccgccggtacggcgaacagggcggcggccgcgaggcaggccgcccagggggtcaggcgcgagattctcatcgggtggggggtacctctccatacgcaccgtccccgcccggggaattggcggagtgtcagtggcagagcgagggtcacattgtcatgtgccgaacaggtgaaaaccatgtgtcgggactgggtgatcttcgtgtgtgccggtcgcgcgccgcgggcagggtagcggtggccccggtggggccggagcgaccatgaccagcccgatcgggagcagcccatggcagtgaagatcctcatcgtgaccggcgacgcggccgagtcgctggaggtcctgtatccgtaccagcgcctgcgcgaggaggggtacgaggtccacatcgcggccccgcaggtgaagaaactgcgtttcgtggtccacgacttcgaggagggattcgacacctacaccgagaagcccggttacacctggcccgccgacctggccttcgcggacgtcgtcaccgaggactacgcggccctggtcgtccccggcggccgggcgccggaatacctgcgcaacgaccccgaggtgcgccggatcctggccgccttcgcggagtccgacaagccgatcgcccagatctgccacggcccgctgatcacggccgcggccggaggcctggccggccgccgggtgaccgcgtacccggcgctggagctggacatgaaggcggccggcgccgagttcgaggactccgagacggtcgtcgacggcaccctggtctcggcccgggcgtggcccgaccactccaggtggatgcgggagttcctgaccgtgctgcgcggcaaggccccggtggcctgagcgggacaacggatcgcacggacggccgtgaccccctcgcacaggggtcacggccgtcgggtcgtgtcggcggggccggttccgaccaggtcgtcgggcggcgccgcccgacggccgtcagctcacgggggtgatcgccggagcggggtcgtacttgtagttcgcgccgaagttcttcttcacggccgcctcccaggagccgtccgcgaccatcttcttcagcgcgtcgttgatcttgcgctggagctccttgttgcccttcttgacgccgatgccgtagttctcgttgctcaggttctggccgagcagcttgaacttgccctcgttgcccttccgggcggcgtacccggccaggatggagttgtcggtggtcatggcgtcgacccggctctcctggagggcgacgacgcagtccgagtacccgcccatctccagcaggcccgccttgggggcgaggttgttgcggaggttctcggccgaggtggagccggagaccgagcacaggctcttcgaattgaggtcctcggccttgttgatcgagcggtcctcggcgcgggtcagcaggtcctggtgcgcgacgaaatacgggccggcgaagtcgaccttctccttgcgcttctcgttgatcgaatagctcgcgacgacgaacttgacctcgttgtactggatcagcagttcgcggtcgttgctgaagacctgcttgaattcgatcttgttcgccttgtagccgagctccttggcgacataggtggcgacgtcgacgtcgaatccggagaaggtgccgtcggtctcccgcatgcctatgccgggctggtcgaacttgatcccgatggcgagggtcccgtccccctggtccccatcgccgaaaacgcacccggaggcggtcagggcgatcgcgatcactgcggcgaccgcaccggcctggggaaccttcatgctgcactctttcctggggaacgcgggacgcgccaccgggatcgccggaggcgtgtggaaccgcgcgtatacggggggcgtcgggacacgtgtacgaggaagctaggaagtggacgggcttaccgtcactagatttgagcaaaacttgaggataacgatccgggtcagccgcggatcgtgcgattggccggcgttggatcggggcaataggcggcgacgcaaggggtgtggcgcgaataggcggaaaagcgccgctatggggtgaagtggcgcgcatcatgtctgcccgtaccccgcggctgccggaatccggtacggacgcccttccgtcgggggatccggagccgtgaccagggccgggccgcatggccgaaccggcctaactggccgaaaacgtacgatcgttcgtaccgggccgggggctcgtgggatcatcggcgggcaatgcctgtggacgaagggggagttcggtgaccggtgtacgcaaggggctggccagggtggagttcgcgctgcggtgggaccccagcccggcgggcacgcccgcgaacgacctcgacatcgtcgccgcggtctacggcggcgccgacctccacgggacgcccgtccagctggtgcacttcggcagccggtcgcccgacggaaccatcaccttgaaccgggacagccataccggccagggcttcggcttcgacgaggtgatgaccatcgaactggaccggatggcgacggggtcgagccgggtggtggtcggcgtggtcatccagaacgccgaggctggccacgcgggccgtaccaagaccttcgccgacatcggcggcaccgggttccggatccgtgagggccacaccgacctcgcccagggtgacttcgcggacgtggccaccgccaccgcggccaccgtcgccgagttcacccgcgacgcctcgggcgcctggtcgttcgacctgcgcctgcacggcttcgaggccgacccggaggcgttcgcccggaccatgggcgcgctccgctgaggccggccgccgccgggaccggtgccgagccgcgcggaccgggcggcggccacccctggggtgagtggccgccgaccggtccgggtggcgcgctgccgccgtccccacgaggcagcgcgggcaggtcgccgtcaggtcatcaggacggcggcccgccggttcagggggcctggtcggccggggggccggtggggagggaaggcgcgaggcccagggacgggagcatcacggcgtcgacgaaccggaccaggtagtcggcgtccgcgtaccgcccttccagtaccgggcggatccggagcacacccatcagctgggcgggcaggaactccacggccggatggtccgcggcgatctcgccccgcgccacggcccgcccgaccatctcggcgaacgcggccagctccggctcgaccagtgcctcgcgcagtgcggcctggagctcctcgtcgctgagcacggcgtgcccgagggcctgcgtcagccgggtgtcccggccggaggtgccggccgcgatccgggccgcctcgcgcagatcgcccgccagggacccggtgtccacggcgacgaaggggccgcggcgtcccgcgcgcagcgcggcggcgacgagctggggcttggtcttccactgccggtagagcgtcgacttcccgcagctggcccgggcggccacgccctccatggtcagcgcctcgtagccgtgctcgcgcagctgctccaggacggcgtcgtagaactcctgctcacgctccggtgtgatcttggagcggcgcgcgggggccggtgtcgacgtcatggatgcggctctcctcggggtcgcctcgacggcaggttccactacggaagtgtacgggaacgcgaccgtatcggtacaccagcgtatcgatacgccaatgtatcgatacactggcgtgtcgctgtgcgcgtaaacaggaagagagaccgggggatgagctcccacaccacacctgccgggccggcagccggaccgagagccgcgcgccgccgactcgtccgcgagctgctgctcgtcgcgggattcttcaccgtctacaaggcgggccggctgctctcgaccgaccgcaccgaagaggccttccgcaacgcggcgcgaatatgggacgccgagcgcttcctgcacctgccgggcgagggcgcgatacagcggctgctgctgcacggggacgccctcgtcaccacggcgaacacctactacgccggcgtccacttccccgcgaccgcgctcttcctgatctggctctacgtccgacgccccgcccactacctgtggacgcgccgcgtactcgccggactcaccggagccgccctcgccctgcacctggccttccccctcgcgcccccgcgactgttcgacgccgcgcggctcatcgacaccgcacaggtctacgggcccaccgtctacaaggccgcaccggccgaggacaccctcgcgaaccagttcgccgccatgccctcactgcacttcggctgggcgctgatgctcgcgctcggcatgatcgccgccacctcctcgcggtggcgcttcctgtggctgctgcacccgctgctgaccctcctcgtgatagtcggcacggccaaccactactggctcgacgccgtcgtggccgcggtcctcctctgggcggcgctgctgctcatcccgaagccacgcacgagcgacccgggccacgacccggaccaccacccggatcggggtgcggacccggaggcgggcccggaaccccgacaggacatccccgtacgaggcctgccgcgcccgcggagcgcggacgcggccgtaggagcaggacaatgaacgacaccgccctcgccgtcgggctctgcctcgcttcggccgtggcctacgcggccgccgccgtagcccaggaacggctcgcccgggccgccgtcgcacgcaccgccaaggccctgctgggctccggcgcctggtggtggtcggccgggctgaacgccgccgcggcgctgctgcacgccgcggccctgcgctacggccccctcacgctggtgcagccgctcggcgcgctcaccctggtggccgccgtcccactgggtgcgcgcaggtccggccgccgggtggccgccaccgaatggcgcggcaccctggccaccgtcgccgggctgggcctgctgctgcttccggcctccgggccggcccccgacgacaccctcacgctgatcgaggcgctggccgtctccggcgcgaccctcgtggtgatcctcatgctgaccgcggacaaggacccgcgttcgggcctgcgccacgcgaccgcctcagggctggcctccgcggcggcctccgccctgacccagacggtggccgtggcggccggtcgcggcggagcgctgctcagcttccgggtcgtcgcggtggccgtgctcgtcatggtgttcgcggtcggcgggatgctgctctcgcagcgggcctaccgcggcggactcggtgccccgctggccgtggtgaacctggccaacccgctggccgcggccgccatcggcatggtcctgctcggcgaacggctgcagggcggggtgccgggactggtgctggccggggccggagccttcctggcggcacgcggggtgctcctcctcacccggacccccgccgcgggggcgggtccgggcgccggtcccggcccgggcgccgagcttcccgtaccggtcggccgcgtggcggtctgagcgtcggagaaccgttccgcccccgggcgcgtcctcccgggagaacgcccgaacgactgaagcggagtgactggacatggggatcgtcagctggatcatcctgggactgctggccgggggcatcgccaaggtcctgctgcccggccgggatcccggtggcctgatcggcaccaccctcatcggcgtcgccggagccttcatcggcggctggctgtcggcgaaggtcctggacaagcccatcacgaccgagttcttcgacctcgccacctggggctccgccatcgcgggctcgctggtcctgctgatcgcgtaccgcatcctgttcggcaactcccgcaactgacccggccccacgcgcccgcccgccgccccggcccctgatcgccttcctcttcggggccgccacgtccctgtacgccctcggcgggctgctcggccggcagctcggacccgcccagcggctgctgcgcgaggacgccgccgccgggcgggtgcacgccgtgcgcgtccggatcggcatcgccgtacgggacgacccgggccgcccgggcgccgccggccgagccggccggatccgcgccgacgcctcccgacgcctcccgacgcctcgaaccgagcccgctcgcgcccggcgacgtccggccgcccgtcgggttccggccgatgtcaggctccaacttccggagcgccaccggcgactagcacctcgcccaggcggccgctcgactcctcggccccgaccgcccccgggctcagggccgtcccggtgcctgtggccctgttcctcgcggtgtgcgcgggcgtgctcgtcctcggcgcgggcctgcggatcagcggccatgcgaccgccgactacgctggccgcaccaccgcgacgtacgagcacgagcagcgaggaatccggtagccagatgagtgtcacccccgtccccaccgcagacctgtacgacgagtacggcgagtccctggccatctgcgccaccgggttccgccagttcggcggccgccggctcttcgccggccccgtacggaccgtgcgctgccacgaggacaacgcgctgctgcgcaccctcctgcacacgccgggcgagggcgcggtcctcgtcgtggacggcggcggctcgccgcgtaccgccctcgtcggcgacctcatcgcgggcgcggccgaggccaacggctgggccggcctgatcatcaacggctcggtccgcgacagcgtcgccctcggcggactcgacctcggcgtcaaggcgctcggcacggtcccgcgcaagagcggcaagaccggcgacggcgcggtcgacgaacccgtcaccatcggcgacgtcaccttccgtgccggggacaccgtccacgcggacgacgacggcgtggtcgtcctgccccgctgacgtccgcacaggcctcgacgggaccgaacggatcggacggacccggcggatcaggacgaccggagggccggaaccggccagggccgcgccaccggccctggcacggccccggcgagccgcgtttcactgcgggcccatgagacgacgacacaggatcaccggcctgctcggcgcgatcgcgctgaccgccgccgccctggccgccgcgggacccgcgtacgccgggaccccggccgcggacccgccgcccgccgagttcggcaccgactggcacgacccgctcaccgcggccccgcccgtcgcccggcccgccacccggtcctgccaggtgaccctcgccgaggcgcagttccgcgacttcacgccctaccggggcagctacacaccgcccgccgactgcggtgcggccggctgggccaaggtggtcctgcgcctcgacggcaaggtcaagggccgccagtacgaccgcctcggccacctcgccctcggcggggtcgagatcctgcgcacctccaccccgcagccctcgcccgacggcatcacctggtccgtcgagaaggacgtcacccgctaccgcgacaccctcgcccgcccgcagcccgtcgagatgctcatcggcaacgtcgtcgacgacacctacaccggtgtcatcgacgtcaaggcgaccctgaccttctacgccgccgacggccgcaacccggcccccgacacccccgaccgcgtcctgcccctcacctccccgtcggtcaccaccccgcgcaacacggagcgcctcctcgccgaggtgtacgccaccggctcgggcggcggctgcgaggagtactggtacatgaccaccccggacgcggccccgtactcctgcaaggccgccgacggcccgtaccgcgaggtccgcgtctcggtcgacggacagctcgccggcatcgccgcgcccttccccaccgtctggacgggcggctggtccaaccccttcctctggtacgtcacccccggcccgcgcgccttcgacgtccagccgatccgctacgacctcaccccctacgccggcctcctcaacgacggccgtccgcaccggatcgaggtctcggtggccggggtcccggccggccagagcggttggagcacccccacgaacctgctgctctggcaggacgaggcccgggcggtcgtcaccggcgccctgacccggcacgagcagagcgatccgggcggccactcccgctggacccccgcggcccccggcggacagcaccgcctggacaccgagggcggccaccggctcaccgtcgccggacacctgaacacctcccacggccgcgtggccaccaccgtcacgcgcgccgtgcggaacacctccgtgcaccgctggaccgacggcgagaaccaggacgcgctcgccgccacctggaccgacgaggaggacgtgacgcgcgggccggtcaccacccggaccgcccgcacctacacgatggacggcgagaccaccctcggcgccggcgaccggctgcgcaccgtcctgtcgctcggcgaccgggccgacaccgtcacccggcgcggcggccggaccgtcgacaactcccgtctcgacgaccggtacacgggcgacgccacctacacggcgaacgtcccgcgcgaccagcggcacgcggtcgccaccacctccacccgattccgcttgtacgggtccgcggcgcccggcggctgttacgaccggacgctggccaccgtccaggggacgctcacggcggaccgcctgcgctgctgagctggccgccccctacgatgagcgcccatggatacgagtgaggccggcagacagctgatcgacggccgtttcgagctggtcgcaccgctaggcagcggcggcatgggtacggtgtggcgcgcccgcgacatcgccctgcaccgcgaggtcgcgctcaaggaggtgcgcccgccggacccggccaccgccgccgcccagccgggcctcgcggaccagatgcgcgaacgcgccgtccgcgaggcccgcgccctcgcccgtctcgcccacccccacgtggtgacgatccaccacatcgtcgagcccacggagggcacggacgggcacccgtggatcgtcatggagatggtccggggcgggtccctgcacgaccgcctggagtccggccccatgccgcccgccgacgtggtgcggctcggcctcgacgtgctgtccgcgctgcgcgccgcccacgccgaggggatcctgcaccgcgacgtgaagcccgccaacgtgttgctgcgccccgacgggtcggccgtgctgaccgacttcggcatcgccgcgctgcacgactccaccggactcaccgcgaccggcgtgctgatcggctccccggagtacatcgcgcccgagcgggtccgcggggaggaggggctggccgcctccgacctgtggtcgctcggcatgctcctctacgtggccgccgaggggaccaacccgctgcgccgggccaccagcctggcgacggtcgtcgccgtgctcgacgagccgatcccggcgcccgtgcgctccggcccgctggcacccgtactggaacggctgctcgtacgggacccggccgcccggcccgacggggcccagctggaacaactgctccgggccgcgagcgccgctttcggatccggctacggggcgccgggcgccgcgccggccgtctccgcaccggcggtctccgcgccgggcgcaccggccgcgcccggcgtcccgggtcagtacggcccgtacggcggcccgtacggatcgcccaccccgccgccgttcggccagggcgcttccccctacgcggctcccaccacgcccgtcgggctggcccccgcagcgcgcaggcgcccggctctgatcggcgccgtgctgaccgtggtgctggcggccgcggtggtcgggatcgtccagttgatgcccgacgggaagtccggggacgacgacgcggccgactcccgcgccacccggcccgccgttgccaccgcgggcggtaccccggcttccacccccgctgcgaaggcgagtgcgtccaaggccggcacggcccgcggcagcatgctcaccccggagaacatccggatcgccctggacgcgctcaaggagaagaccggcaccaccaccttcgtggacctcaaggtctacgagggctacgttctcgccaagatccccaccgcacccggcgccgagaccgtcgacgcctggcagtaccgtgacggcgccgcccggcgcacgggcccggacggcaccgtcggggagggcaagccgctcatcgacatggccgcggtcaactgggacgcgctgcccagcctgttcgagcagaccaagaaggagtcgggcgtcgagaagccgaccatgacctatgtggtcgtcgagccctggatgatggaccaggtcccctgcatgcggccctacctcatcgacgagtacggtcgcggcggctatgcgctcgccggtgtcgacggcaaggtcaagaaggtcaccaagttctgacatcgtcatacccgtgcgtgcgtacgcacgtgcggaccgacgcgttcaggagtacgaccacgatgcccagctggcgcaccaccctcacgggggccggcatttccggcccccggctgcgcgacgactacacccacgccgcgcgccgggtgctccgccgcgagcccgccccgtacctggcgctgcggctgctcgccgcgccgccgctggtgcccgccctcgccgcaggtctcgccttcatgaacctggtcgacgacgtcgccgagaccggtaccccgcagcaacgggcggccggtctcgccgcgttgtccgagcgggtggaggcggccctgacgtccggggacagccccgacccgcttctgcgggcctacgcgcacgcggtggacgcccgcggcctgcccccgcactgggtctcccgcttcctgaagggcgcggccactgccgaggcgggcttcgacggcttcgccgcggaggaggacttccaggcctacctcgacgcctacgcgtggcccggggtgctggtcttcaccggactgcagtaccagggcggccccgacccggagcaggccgcgggctggcggaggttcgtcgacgccgcccagcgcgtggacttcctcgccgatctccgcgaggacctcgcggacggccggctctgcatcccgcgcgcccggctcgacgagcatgcggtgacccgcgccgacctggaacaggcccgcgacaccccggccgtgcgcgctctgctggccgccgagtgccggcgtgcccgtacggccctggacgccacccacggcatcctcggcctcgccgaacccgggctgcgtcccgtcatcgcgaccatgacggagctgatggcgcaccagctgaccgccgtggagcgggcgggggtgaccgccctgcggcgggacatcggctacggcctggcggcgcccctgcggatcctcgtccgcgccgcccggcatcgcccggtgtgaaccggcgcgggtttcccggcttctagtaggccccgttgacgttgtcgatcgagccgtaccgcgcggccgcgtagttgcaggcggcggtgatgttggcgaccgggtcgtaggagttctgcgaggtgccgggcacgtggtaggcgcggaaggtcggatcgatgacctggagcagccccttggacgggatcccgttctgggcgttgatgtcccagttgttgatcgccagcggattgcccgaggactcccgcatcacattgcggtgaattccgttgtaggagccgggaataccgtgcttggccatgacggcgagggactcgcggatccacccgtcgagattgttcgggtaggcggtcgcgggcttcgcggccggcttggcagcgggcttggcagcgggttgggcggcgggcttgagggcggtccgggcggcggacctgctcgcacgttcggtctccgccggggtgccgagcttcagtttgatgccgggccggatgatcgacgggttgtcgccgatgacgctccggttcgccgcgtagagctgctgccagccgccgctcagggaatggtccgccgcgatctccgaaagggtgtcgcccgcgaccacggaatacgtcgtgggggcggcggccgtctccgccgccccggcggtggtcgcgctgatcaacgggagagtgagggccgcgccaccggtgccggcgagagccagcttgcgggtgatccggtactgcttcggccgacggtgcttaccctttgcaggcatggcggaattcctcacgtggggggacgggagatcccgggcggcggccttatcaggcagctgaccaccaggaacgaggtgaccgtaggtgagctcgccacgtgggaacaagacccgaattccaccgatagatcgacatctcgctatcggacgggtaaatgaccttgaaggggtatcggtgcaatagccgattccctttccggggaaagggaatcggctgttttccggaaatgatgttgaggtgtccggtgtggctcacatcacgggtcgccgaccggacggccaatacgggcaagtccgccctccggtgggctcattcgggcgactagcccttaggcggcgaatcgcccattcgggactctttccggcggatcgccggccggtctgcgcccgcgggtcacgccagccgctccagggccgccgtcacggccgccaccgccccccgcgaggccggcagcaggggcagccggacgtccggggacgggatccgcccctgggcgtgcaggacgcccttgatcaccgccggattgggctcggcgaaggcggccgccgacatccgggccagcgcgtgccccagcggccgcgcccgggccgcgtcgcccgcccgccaggccgcggcgagctccgtgaaacggtccgtcgccagatgcgccgaggccaggatcccgcccaccgcgcccagcgccagcagcggtgacaggtacacgtcgtcaccggccagcaccccgaacccggccggcaggtcaccgagcagcgccaccgcgtcctcgccgatgccaccgcccgcgtacttcaccccggcgacccccggcagctccccgagcgcccgcagcgcggccgcgtccagcggctgccccgtccggtaggggatgtgataaacgatcagcggtacggggctcacctcggacagccgcgcgaagtgcgccagcaccccggcggccgagggccgcacgaagggcggcacggtcaccagcgccgcccgcgcttcgggccaccgcgtcagccgggtcagcgaggcctcggcggcccgggtgccgcccgcccccgcgccgacggtcagcggcgcgccccgctcgccgcagacgcgggcgcacaccgacgtgacgaggtcgcgctccgcctcgtcgagtccggcggtctccgcggtggtgccgagcgcgacgatcccggtcgcacccgcgtcgagcacctcgtgggccagcacctccagcgcctcggcggcgacgcctccggcgcgggtgaagggggtgacgagcggtacgtggatcccgtgcaacgggaaggtctgtgcgatgccctgtgcgatgtcctgtgccatgcccccgagcctcgcccgctccgaggatcaaatccagttcgcatttcttacccgacccataagctgagccgatgctcgatgtacgacgcctgcgcctgctgcgcgaactcgcccgccgcggcaccatcgccgccgtggccgaggccctcgccttcagcccttcggcggtctcccagcagctcggcgtcctcgaacgggaggccggcctgcccctgctggagcgcaccggccgccgggtccgcctcaccccggccggccagaacctggtccggcatgccgaggccgtcctcgaacggctggagcaggccgacgccgacctcgccgaggcgcgcgggggcctggccggggccctgcggatcggcgccttcccgaccgccacccgggccatcgtcccggccgcgctgatcgccctcgcccggctccacccggggctggagccgatggtctcggagaccgacccggcggcggtggcccacgccctgcgggccggggacctggacgtggccctggtgcacgcgtacgacttcgtacccgccgagcccgagccgggactggccaccgaaccgctctacggcgaggcgatgtacctggccgcgcccgcctccgaggcgcccggcccgtccggggaaccggaccagggcgcggtcctgcgtacgcacgcccgggcaccctggatcaccgccaccccaggcacgctctgccacgccatgaccgtccgggcctgccaggccgccggcttcaccccccgagtccgccaccaggtcgacgagttcgccaccgtgctcgccctcgtcgcggcaggccagggcgtggccgtcgtaccgcagctcgggatcacgggcccggccgatccggcggtacgcctcacccgcctgctcatggagcgccgtaccaacctcgccttccgcagcggagccggcgcccacccggccgtggccgccttcgggacggcacttcgcgccgccgtaccaccggatctggccgggtcgcgcgccgtgaggtgacacaactcccgtacggcgtggcatccgtgtacgttcgttgatccagacggattcgatcagagcagaggtacgacgtgacgcatcgcgtacgaggggtcatcgcccggagcaagggcgcaccggtggagacgacgacgatcctcgtgcccgacccggggcccggcgaggccctcgtccgggtgcaggcctgcggggtctgccacaccgacctgcattaccgcgagggcggcatcaacgacgagttccccttcctcctcggccacgaggccgccggagtcgtcgaatcggtcggcgcggacgtcacctccgtggcccccggcgacttcgtgatcctgaactggcgcgcggtgtgcggcacctgtcgcgcctgcaagcgcggccgcccctggtactgcttcgccacgcacaacgccacgcagccgatgacgctggaggacggcaccccgctctccccggccctcggcatcggcgccttcgccgagaagaccctggtcgcggccggacagtgcaccaaggtggacccggccgccgccccggccgccgccggactcctcggctgcggcgtgatggcaggcctcggcgccgccctgaacaccggcaacgtcggccgcggcgactccgtcgccgtcatcggctgcgggggagtgggcaacgcggccgtggccggagcccggctggccggcgcctcgaagatcatcgcggtggacctggacgaccggaagctggagtgggcccgcggcctgggggccacgcacaccgtcaacgggcgcacggacgacgtggtcaaggcgatccagggcctcaccggcggcaacggcgcggacgtggtcatcgacgccgtgggccgccccgagacgtaccagcaggccttctacgcgcgcgacctcgccgggaccgtggtcctggtgggcgtgccgaccccggagatgaagctcgaactcccgctcctcgacgtcttcggccgcggcggcgccctgaagtcctcctggtacggggactgcctgcccgagcgcgacttcccgctgctcatcgacctctacctgcagggcaggctcgatctggacgccttcgtctccgagaccatcccgctcgacggcgtcgaggacgccttcgcccggatggaacgcggcgaggtcctccgctcggtcgtcgagttctgacagcccgtccaccccgtccgcccagcccggcaggtcctgcccggccgggcccggcaggtcctgcctagactcggaccgccacaactcccgcgcccccgccgtcacccggccgggggcgcggtccttcctctcctcgtacccctgggggccgtccgtgaccatcgcacacagctaccgccagcccggcacggtcctcaccgaccaccggttctccgtccccctggaccacgcccgcccggacggggagcggatcgagctgtacgcccacgaggtcgtggccgccggcaaggaccccgagacgctgccgtggctgctctacctggaggggggtccgggcttcggagcccgccgcttcatcggccgccaggcctggctgcagcgcgccctggccgagtaccgggtgctgctcctcgaccagcgcggaaccggccgctcgaccccggtgaaccggcagaccctgcccctgcggggcacccccgaccggcaggcggagtacctcgcccacttccgtgccgattccatcgtgcgcgacgccgaggccatccgccccggcctgaccggcggcgcgccctggaccgtgctggggcagagcttcggcggcttctgcgcgacccactacctctccaccgcccccgagggcctgaccgccgccctgatcaccggcggcctcccgtccctcaccgccaccgccgacgcggtgtaccaggcggcgttcccccgcatcgagcgcaagaaccgggcccactacgcccggtacccgatggacgtcgaacgcgcccgccggatcgccgcccatctcgcggagcacccggccgaactccccggcggccaccgcctcaccgtcgagggattccagtccctcggcatcctcctcggcggcggcgacggcagccaccagctccactacctgctggaggacgccttcgtgacgacccccgggggacccgccctctccgacgccttcctggagagcgcccgctccctgctctccttcgccgggcacccgctctacgcgctggtccacgaggcgatctacgcccaggaccccgccacgcccaccgcctgggccgccgagcgggtgcgtgcggaccacccgcgcttcgacgcgagcaagacgctcgccggtgacgagccgctgctcttcagcggcgagaccatccacccctggcacttcaccaccgacccgtccctcgccccgctgcgcgagaccgcggaactcctggccgcccgtaccggctggcagccgctctacgacccggcgcgtctggcggccaacgaggtgccggtggccgccgccgtctaccacgacgacatgtacgtggacaccgcgcactcgctggagacggcccgctccatccggggcctgcgcacctgggtgacggacgagttcgagcacgacggcgtcctcgccggcggcacccgcgtcctggaccggctgctgtccctcgtccgcgacgaggcctgattgctgtccgctcaggtcaatggctcgacgaggggcggctgttcatcgctcccgcagaagttgatcacacggttggggtgggcgctcgtacccggagaaccgaccgatgtgtggagtgtgcatgctgagaaggatgtcgagcgccgtctcgctggccctggccggcggactggccatgaccggggtggtggcggggacggccacgaccgccgtcgccgcccctgccgtcagcgctgcgggggcgggggagacccccgtcggcgcctaggcctggacgcgcgtgtccaagaagaacccgaaccgctcctcacaccatcggctgatgccacctcagcctgccgggccggcgccccccttcaggggcgccggccggcgtcgtctctgcgggcggctccacgaacgcgcgagtcaggtgcgcggtggccagcagggcaccgcgccgccgggccagcgccagcaggtcctcccgggaggcccgggcggtccgccggtcgcgctcgtgggagtacggcaccgccgggtcgcccagctggaccgcgtgcaccagtacgtccccggtgaccaccacgtcccgggccccggcaccctggtccaccagcaccgactggtgccccggggtgtggccgggcgtcggcagcagggtgatgccgggggcgggccggtggacgccgtccacctcgtgcagccgcccgctcgcccggagcggagccaccgtccagtcccacaccgggtccgcccggtccagcgcggccacctccgcgcgctggacgatgtaccgggccgccgggaagaagggctccccgtcgatccccgacgcccagcccgcgtggtcctcgtgcaggtgggtcaggaccaccgcctccacgtcggccggagcgattccggccgccgcgagggcgtccggcagccgccccggcaccggtgcccacgcggcggcgggggactgcgccggcccgaccccggcgtccaccagcagccagcggccgccgggccgggcgaccgcgaagcacctgaaggcgagcgcccaggacccgtcgggcccggccgcgccgggatccagccgcccggcccgctcccaggccgcctcgtccgccccggggaaagcggtgcgggccggctcgaagaagatccccgtggcgtcgagcaacgccaccacctgcccatgacggtccattcgcctattgtgcgagacatgaccgaacaacctgatcagcagcccgccttgcagcccatgcccgccgactggacgcgggccctcgcggtggtcgcgcaccccgacgacctggagtacgggtgcgccgcggccatcgcgcactggacggacgggggccgtgaattcgtctacctcctcgccacgcggggcgaggccggcatcgacagcatcgcccccgccgagtgcggcccgctgcgcgaggcggagcagcgggcgagcgccgcggtcgttggcgtctccgaggtggagttcctcgactaccacgacggcgtcatcgagtacggcctcgacctgcgccgggacatcgccgcggccatcaggcggcaccggcccgagctgatcgtcaccctcaaccaccgtgacacgtggggcggcgcgcagggcggcggctactggaacacccccgaccacaaggccgtcggccgggccgtgctggacgcagccggtgacgccgggaaccgctggatcttcccggagctcatcgagcagggcctggagccgtgggacggcgtgcgctgggtcgcggtggccggatccgccaccccgacgcacgcggtcgacgccggcccggggctggagcgttcgatcaagtccctgctggagcacaaggcgtacatcgaggtgctcacggaacaggaccccgaggagtacgtccgtaccttcctcaccgggaacgcccagcaggccgcggcccgcttcggcgggcgtccggccgtggcgttcgaggtcttcccccgctgaccggccacccctagtctgacgatccgtcagttcgacggtcgtcagccagcgggccgggggtgcgggacacggtgatcgacaccatttccacggagatcgcggagggtgaggagcggatccggctggaggtcgcggacggcctggccgtcctcaccctgtgccgcccggacaaactcaacggctggagctgggagtccacccgccagctcggcctgctcgcggaccggatccgcttcgacgcgtccgtacgggcggtgctgctgcgggccgagggccgggccttctgcgcgggcatcgacgtgagcgccccgggcggcgctgtcacgggcggctccccggccgagcgcacccgcaactactacgagggcatccgctgggtgcacgagcggttcgcggtcctggcccgcctcccgcagccggtggtggccgcggtccagggctactgcctcggcttcggcttcgagctggcgctgatggcggatgtccgggtggcggccgaggacgccgtcttcgccctgccggaagccgggctgggcgtggcggtggacgcgggcggcgacctgcgcatcgcccgcgaggcgggtgcgggctgggccaagtacctggccctgacgggccggcgcatcgacgccgcgacggcgcagcggctccatctggtgcaactggtcgtccccggcggcgagctggaggccgcctcgcgctccgtggcgcgggagatcgccgccaacgcgccgctcgccgtccagggcatcaagcgggcgatcgacgggtatgccgatgcggccctgcccgcggcgctcgaccgggtggcgatgaccgcggccctcaccctcacctcggaggactgccgggagggctactccgccaaggcggcccgccggcccccgcgcttcagcggaggctgagcacgggccgggtcgagaacgcctcgtacatgcccgcgccgtccggtccgtacgcgaactcggccgcgtacgggttgcggttggcggtggccagcggcagccagccgagcagggtgccgtacccgccgcagacggcctcgccgccgtccccgccgtgcaccgctgtcgggtcgccgctgagctccgtgcggtagctgtcgtaggcgatgtgcagcccgaaggcgttcggttcgtggcgcgggccgccgctcccgtacgacggctcgtccagggggcactcgttcccccaccggaacagggtgtccgccccggccccgcacgcgtgctcccactcgtcggcgccgggtatccgcagtccgcgcgccgcgagcgcggccggcaggtcggccgcgcacccggtcaggtgctcgtcctccacggccatgagcacggtggccagcgtggccgtgcgcggcggactgagcacgtcggcgagataggacttcaggtcggggtgcccgtacccgtacccctcgtccgcgctctccgcgtagtcggcggcctgggcgggcgtcggctcccaggcgtccaggtcgaaccccagccgaaccgtcccgccggggacgagggcgaactcccgcccctcgcgctcgacgcgtacccggtgcagcggcccgccgaggtggccgacggcgtcgagcagcaccacgcggccgcccacctgcgccgcggcctcgtgggcgacgcgttcggcggcggcccggtcgaaggagcgccagcggtcgagggtcaggtcggcgagagacatgccccgatcctcgcaccacccactgacaacgggcgttcagggggcgtcaggaggaggcggtgaaggggccgcgccccagctgggtgcggaccgggaccacctcggggttgaccaccgagcggcgctgccagttcgccccgtccaccaccagcgtgtgcccggtgacgaaccgggcgtacggggaggccaggaaggtggcggcccagcccagttcgcgcggtgcgccgacccgcagggcgggctgccgggcgtccttcgtgccgggcgcggctcgctccagcccgccccggatgtcctcgctcatgtcggcgtgcgggaacagcccgggcacgagcccgttgatctggatgccgtacgggccccactcgaccgcgagcgtctccaccaggttcttcaccccggccttggcggcggcgctgtgggcgaagccgggtccgcccgtccatgcgtaggaggcgccgatgttgacgatcgagccgggggtacccgcggcgaggtggcggcggccgaactcgcgggtcatgaaccaggtacccgtcagggtgatgtcgaccaccgcccgccaggcacggggggagaggtcctcggccggggaggggaagttcgcggccgcgttgttgaccagcacgtccggcagcccgaaggccgcctgagccgcgtcgaagacgtcggcgacccgctcgggatccctgatgtcgcagacggcggccgtcacccggcccgcgccggggacggccgccagctcctcccgcgccgccttgagctgctcggcgcgccggctcgcgatcaccaggtcggcgccgagccgggcgaactcggtggcgatggccttgcccagcccggtgccgccgccggtcacgaggaccacctgcccctcgtaggtgccggggggcagggcggcggcgccgagcgccgggggagcgggcagcccgcgcgggatctcgtccgtcatggggcatcgatagcgcgcgggcgccgagatcgccatccctctgacaggaccgactcgggaccgcgctccggaaccgcccggcggtcagcccggcggtcagccctgcggggcgtacgcctgcttgctcgcgcaggtccagaccacggctttgctgtcccgcgtctcccggtcggtgatcatgccgccgacacggtcgtcgtcggtggccgcgaaggcccggctcagcggcacgcccggggttccggcggggaagggcagcaccagcggctcccccttgccgggccagtagacggcctggaaggaactgggccagctctcctcgaagttggtggccgtgccgacggccacgttcgtggtcgggctgctgccggagagctccaggtcgtggtagcccttggcccggcccgggtcggtgggcagggcgtcgtacggcttcttccagacggccggggtcagcttcgggtcgttgcggtagtagtagtcctccaggcccaccacccggccgcggtcgtcgatgtcccggccggtcgtcacgaacgaggagtggtagccgttccacacctggaggctgtagggcgggtagccgccgccggcgggccagaccaccgggaaggtcttggtgaccatgatgtcgttctcggcgtcgaagtaggagccggagaccgtgccgaggatgtcaccgcgcttgttgacgccgttcagcgaggtgaccttgctgccggcgatcgcgtcggccgggacgggcagttcacgcacgaccttcccgttcacccactccttggcgacgcccccgtcggcgaagacgacccgccccgactcgttgacgtcgacatcggcgaagagcccctccttgcccggggcggtgagcggctcggaggccgcggagccccgctggtgggtgaaggcgaccatggcctggtccgaggcgcgggtggccgtgcccaccatcaggcccttggcgctgaccgccttgacgctgccccggtcgaagccggcgggcagcgggacggcgtggaccgtgtgctcgacgccggtccagtagacgggcagaccggcgctgtcgccgaccacgatcccgccggtgccgaagcccaccgcggtggagcccgtcgatcccggcagtcccgggaggatctcgatcccgggggcgcaggaggccgtcgtgcccgccgccgcggccgggccggccgcggtgatcaggccggccagaacgacggcggctccggccgcggacatgcttcttctcatgtggtggtcccccctggacaggtgctgttccccgttgagtcatgacacgtgcacgccacatgttgcctgatcttgaggcgcaagtggcctgaatggcgcgtgttgatccggaccggacggttctccaccccgaccgacggttcacaagagggcaagcgaccgcttagtatgcccgcggagcgtggttcatcgacggcggctggaggccccggatgcaggcatggcgagtacatacccccggcgaaccccgagaggccctgcgcctcgaagagattcccgaaccggtcccgggcgagggcgaggtgcggctgcaagtgctcgccgcgaacctcaacttccccgacgcgctgctcgtccgcggccagtaccagatccgcccgccgctgcccttcacccccggcgtcgaggtctgcggcctcaccgacgacggccgccgcgtcatcgccaccccgagcctgccccacggcggcttcgccgagtacgtgatcgcgtccgaacgggctctgctcccggcccccgagagcctgaacgacgcccaggccgccgccctgcacatcggttaccagaccggctggttcggcctgcaccgccgggcgcgcctccagccgggcgagaccctgctcgtgcacgccgccgccggcggggtcggcagcgccgccgtccagctcggcaaggccgccggggccaccgtcatcggcgtcgtcggaggcaaggacaaggcgcgaaccgccgaggaactcggctgcgacctggtcatcgaccggacggccgaggacgtcgtctcccgggtgaaggagttcaccgccgggcgcggagccgacgtggtctacgaccccgtcggcggcgactcgtacacggcctccgccaaatgcgtggccttcgagggccggatcgtcgtcgtcggcttcgcgagcggcaccgtccccgcccccgccctcaaccacgccctggtcaagaactactcgatcctcggcctccactggggcctctacgcgaccaaggacccggccgccgtcctggcctgccacaccgaactcacccgcctcgccggcgaaggcgccatcaagcccctcatcagcgaactcatcgcactccctgccgtcgccgacgccgtgcagcgcctcgccgaggggaccaccaccggccggatcgtcctcgccatgccccggcagccgggtgtgtcccgatgaccgtgatcaccgccgaacacctgctcacacgcgtacgggacctgctcgccgcccacccgcccgccgacaccgaccgcgccgacttcctgcgcgcccgcttcgacgccggactcgcctgggtccactaccccgagggcctcggcggactcggcgcgccccgctccctccagagcgtcgtcgacaccgaactggaggccgtcggcgcacccgacaacgacccgcgccggatcggcatcggcctcggcatggccgcgcccacgatcctcgcctacggcaccgaggagcagaagcagcgcttcctgcgccccctgtggctcggcgaggaggtctggtgccagctcttcagcgagcccggcgccggatccgacctcgccgcgctcggcacccgcgcggtccgcgagggcggctccggcgactggatcgtggacggccagaaggtgtggacctccagcgcccacaccgcccgctgggccatcctgatcgcccgcaccgaccccgcgcttcccaagcaccagggcatcacctacttcctctgcgacatgcacgccccgggcgtcgaggtccggccgctgcgccagatcaccggagaggccgagttcaacgaggtgttcctcaccggcgtccgcgtccccgacgcccagcgcctcggcgccgtcggcgagggctgggcggtcgcccgcaccaccctgatgaacgagcgggtctccatcggcggcatgcgcatcccgcgcgagggcggcatgatcgcccccgccgccgcggcctggcgcgaacgtcccgagctgcgcacccacgccctccaccagcggctgctggaactgtgggtcgaggccgaggtcgcccgcctcaccggggaacggctgcgccagcagctcgtcgccggacagcccggccccgagggatcgggcatgaagctcaccttcgcccggctcaaccaggagatcagcgggctggaggtcgaactcctcggggaggagggcctcctgtacgacgactggaccatgcgccggcccgagggcgtcgacttcaccggccgcgaggccggctaccgctacctgcgcgccaagggcaacagcatcgagggcggcaccagcgaaatcctcctcaacatcgtcgccgaacgcgtcctcggcctgccccccgaaccgcgcgacgacaaggacctcgcctggaaggacctcaaccgatgaccaccgcggccgcgcccaccgacctgctctactccgggaccgaggaggaactgcgctccgccgtacgcgcgctcctcaccgaccgctgcgacgccaagagcgtcctcgaccgggccgagaccggccggccgcacgacccggcgctctggcacaccctcgccgccgggatcggcacggccggcctcctcgtacccgagaaactcggcgggcagggcgcgagccaccgtgaggcggccgtggtcctggaggagctgggccgggccgtggcccccgtcccgtacctgacgagcgccgtgctcgccacggagatcctgctcggctgcgacaccgcggaagccgccccgctgctgcgggagctggcctcgggcagcacggtgtgcatccccgccgtgccgctgaccctcgccccgggcgcgcccctcccggcccccgtccgggaccacggcggcggcgtcctgaccggcacggtcacctccgtggcggacgcggtggccgccgacgtcctgctggtcctggccgacaccgggctgtacgccgtcccggccgcctcggcccggctgaccccgcgggtcccgctggacctgacccgccccctcgccaccgtcaccctggaagcggccgagggcaccctcctcgccgacgccggtacggcccgggcggccgtcgccggagccctgctctccggggccggcctgctcgcctccgagcagctcgggctcgccgagtggtgcctgaccgagaccgtcggccacgtccggggacgccaccagttcaaccgccccgtcggctccttccaggcgctcaagcaccgcctcgcccggctctggctcgacgtggcctccgcccgcgcggcggcgagagccgcggccgacgccctggccacggcggcccccgacgccccgctgacggtcgccgtggcccaggcctactgctcgggcgtggccgtccgcgccgccgaggagtgcgtacagctgcacggcggcatcggcatgacctgggaacacccggcccacctctacctcaagcgggccaaggccgacgccctggccctcggcacggcgggccaccaccggggcctggtggcggacttcgtggaactcccggccccgtaggacggcatgtccggtacggcctcctcccggtccgggaggaggctccggccccctccgcctcccggtcccggcccgggcacagcctcccgggacgtgccgccccgcctccggcggggggtgggacggtccttatcctcgccccatgacggccaccatcaccgcgctccgcgccgacggactccgcgcccaccgcgacgaactcgcctccctgctgctcgccgtggtcgacggcggctcgtcgctcggcttcctcgccgggctcgacgaccggggcgccgccgcctggtgggactccctgctgcccgccgtcgaggacggttccctcgcgctgtgggtctcccgcaccggcggcgacggccgcatcgacggcaccgtcagctggtaccgggagaccaaggcgaacggccgccaccgcgccgagctgcgcaaactcatggtccacccggccgcccgcggccgtggcaccgcccgggccctgctcgccgaggccgaggcggcagccgcccgagccggggtgctgctgctgttcctggacaccgagaccggcagcggagccgagcgcgtctaccgctccgcgggctggacggaggccggcaccatccccgacttcgccaccgaccccgcgggccgcctccaccccacgaccctcttctacaagcagctccgcggcgcccacgggtgacctcgcccgccgcgcggcgttagacccgtagccgccggccaccgagcgagggagaccgtatgtccgcagcatcgcccgccgcaccactgacccgccgcgcggttctccgtacggccttcaccgcggccgtgctcgccggtacggccgccgccctgacccccgtactgcgcgcccggcgcccccggcagaccctcaccccggctccgctggccgaggaggagacgtaccgcggccggcacatcgccgtcgacgtcgccggggtccggatcgacggccgcccgctgcacgtcatgcgccgggccgacggcagctacctcagcgggatcaaccacttccagtcctatgccacgccactggaactggcccgggccgccgtcgacgagctgggcaccgcccagctcgccctcgcggccccgcaccacggctgactgacccacgggaacgggaggacccccgcgttgcacgtccggcagaaccagaagaacctcaccagcgcccagaagaagcggttcaccgcggcggtgctggagctcaagcgcagcggagcctacgacgccctggtgcgcacccacgacaagtacttcgtgcccgaccgcgcccgcaaactgcgcgtcggacacatgtccccgtcgttcttcccctggcacaggcgctatctgctggagttcgagcggcagttgcaggcgatcgacccggccgtgagcgtcccgtactgggactggaccgccgacgccagcccggtgtcctccctctgggccgacgacttcctcggcggcaccggccgggcgagcgaccgcaaggtgatgaccgggccgttcgcctacgacacgggcaactggacggtgaccgtgggcatcaccgagtccgcgttcctcacccgcaacctcggccggccgcagaacccgatcgcccttcccaccgaggccgaactccggtgggcgatcgacgacccgacctacgacgtcccgccctgggactccacggccaccgcgggcggcttccgcaacaagctggagggctggtcggcccccaggagcgagcgctggcgcaaccacaacaaggtccaccagtggatcggcggccacatgacgggcggaacggcccccaacgacccggcgttctggctgcaccacgccttcgtcgacctgatctgggaccgctggcagcagaggcaccccggctccggctacctgcccgccgccccgctcgccgtcggcgacctccagcgcggccgggtgatcgccctcgacgagccgatgccgccgtggaacgtcaccccgcgcgagatgtccggccaccagggcctgtaccgctacgaatgacccgcacccgaacggcccgtgcgcacggggcggacacgggagagggcccccgccgggtggcgggggcccttccgtcgatcagcggatcagcggtcagccgatcagtgaccgtagtcgccaccctcggtgtggtggtcgccgccgccggaggcgttgacgcaggtgttgccgaacgccgggttcagcagggcgatcacgttcacggtgttgccgcagacgttgaccgggacgtgcaccggaacctggagcaggttgcccgacaggacaccgggggagccgaccgccgcaccgtgcgctccggcatcggcgactgccagacccgcaccggcgaccacggcgctgccggtgacagcggtgatggcgaatgccttcgcgatacgcgacatcaagatctcctcatgagatatgtggggcgccacaggctctgtggcatttgacatggcatacaacgcgggggaggccaaggggtcacggcccgtgcgcctacccggtgacggaaaaccggacggaggcgaaatacggccgcacctggccgacctccccgggccgcaggacccgcagaacccggcccgagcacccggggccctcgtagagggtggccgagtgcccggtcccgttggtgaccgcccgggctccgccgccctcggccgccacgcaccccctcggcgcggtgaggccgtggacccggtcgtcctggccgacgtactggaagtccggcccggcggccagggccggcccggcggcgagtgtggcgcccgcgagcagcacggcgacgggcacggcatggtggatacgcaggaatcgcatgcccgtccaaccgggccgggccgggacccggtcacgccttgtcacccgttggacggctgtgcgaccgtgcgacggtgcgaccggcaccccggcatcgcgggaggacgagatgagcgcagacggcgccacaggcgcccgcggccggccgcgggccaggacggccgcgggcctggtcgagggccggaccgggcccggggggaccgccgtcttcctgggcatcccctacgccgccccgcccgtcggcgccctccgcttcgcggcgcccgcgcccccggccgcctgggacggcgtacgggactgcgcccactacgggccgaccgcgcccaaagtgccctacccggacaccttcgcggccctgctgcccgacccggcgatccccggggacgactgcctgaacctgaacgtgtggacccccgacccggcccccggcgcccggctgcccgtcatggtgtggatccacggcggggcgcacacgcggggctcctcggccgtccccgtgtacgacggctccgccttcgcccgcgacggcgtcgtgctcgtctcctgcaacttccgcctcggcgtcctcggttacgggctcttccccgacgcccccgccaaccgcggcctgctggaccagatcgccgccctcgcatgggtccgcgacaacatcgcggccttcggcggggaccccgaccgggtcaccgtcttcggtgaatccgccggggccatcagcatcggagccctcctcgccgccccgcgcgcggccgggctcttcacccgggccgtcctgcagagcggggcccccgaggtcctgccgcgccccagggtccgtgccatggtccggcggatggcctcgctcctcaaggtggacgccacggccgcggccttcaccgcgaccccgctgcccgacctgctcgccgcccaggcggccgtcctgcgcagatccggcccgctcatcgccggacccgccttcggcctggtcaccgatcccgggacggtcccggccgaccccctcgacaccctgtgcgccgcggcctcctccggcgaggtgccgctgctcctcggctggaccaccgaggagtaccggctctggctcgcccccaccggcgggatgcggctgctggaccgcctcggcccgctcgccgtggcgctggcccgggcgcgggccggcgcggaccgggcggccgtacgggcgctgcgcaccgcgctgcccgcggcgggtcccgccgagctcgccggacagctgctcaccgaccggctgctgcgcgacccgctgcgcaagctcgccggcgcgcggcgggcggcgccgagcttcctgtacgagttcggctggccgtcgggggttccgggcctgggcgcctgccacgccctggagctgggcttcgtgttcgacacgctctcggtgccggaggccgcctggctggccgggccggacaccccgcaggcgctggcggacgagatgcacgcggcctgggtgcggttcgcggtgacgggcgatccgggctgggcggcatggaacggcgacggcccgccgaaggtgttcggcgggccgtcgcccgatcgtgagggagcgccggtggttactcgacgggcccttccatgaccttgctgatgaactggaccggtccctcgcccatgttcggcacataggtcttggcgttgtgctgcccgcccttgatgaccttcaactcggcgtggatggggcccttgttgccgtaggtggcgacgaacttctgcacgtcgggcagggtcttcttgttgctctcgctgtcaccgacctggaaggcgaggtagacctccggccccttggtgtcgatgagctgcttggccaggagctccgggttgttctcggccttctccttgtcgtggcccttccacagcgaggagtccgggacgacgtccgggccggaggcgatcacggccttgaacttgtccgggtgcttcagcacggccttcaggcccgcgaaaccgccggtggaggagcccatgaaggcccagccgtcacgggacttgacggtgcggaagttcgccttcatcaggtccgggacgtcctcggtcagccaggtgcccatcttgggctggccggggatgtcggagccgtcccagtagacgcccttgtcgtccggccccgggttgaggaccggcatggccaggatgaagggcttgctcttgccctccgcgtaccacttgctgatgctggtctggagaccgaggtcggtgcccatccagtagttgctggggtaaccggcgccgcccggcagggcgatcatgaccgggaagccgctcttggcgaacttcgggtcgttgtactccttgggggcccagacccagaccttgcccttgaagccggacttcttgccgtccagggtggtgacggccacgtgcgtgccgtcggcgagggtcatcgtgttcttgaactcggcggccggcccggtgggcatgagcatcttcgagttcggcgggggagcgtcgttcttcttgccgccgcccgagggcgcctgcccgaaggacaccgcggagcccttgtcggtgaacgggggtatctcgtagtggttcagcacgagcgcggctatgccggcgagcgcgagcacggaggcgcccgctatcagccagcggcggccgcgcgacttgcggcgcggcggctcggagccgtcgtggtgaccctgctggccgtactgctcctgctgcccgtactgctcctgctggccgtactgctcctgcggtgcgtacggggcctgctgcccgttccggtcgtgctgcccgtacggctgctgggggcggccgggctgcggctgctgtccgtacggctggccgtactggtcgccgtggggcggctgcgggatccgtccttccggccggtacggctggtactgctgcccgtcgggtgcgtacgacatgtgcggtggctctccggctgctgctgccccagaggggcggggtggtctgactgctgggtccttccgttcgaaggatgaacgcaagcatgtcagggttccgcattttccctactcttggggtgccctgggggaggccattgcctggcccccgtacggctggtggagttcaccgacccgtccccgcccgtgcctggctcttgtccgggccgctgggtatggtgcccccgcgccgcccccggaaccccaccccgccccggagtcctcccatgacgctccagcgccggatcctgatcctggccaccgccgtggtcctgctcgccgccgtgggcgtactcgccgtcgtgcgggcctcctcgcgcgccgccgagaaggaccacgcccggccgggcggcccgtccgtcagccggggcgcgctctcgctggcgccgggcgacggcggccggcggatcgtgttccgcaccctggcctgggggccgcaccgggacgagctcgccacggtcgccgccgacgcaccgcaaggggcccggaccacgtccggggtgagctgcctgcgcttccacgccgcggccggcaccgggatctgcctccagtcggaccggagcgggatccaggagggctaccgggccgtcgtactggacgcacacctggagcaggtgtccgcgtatccgctgggcggcctccccacccgggcccgggtctcgccgggagggcacctcgccgcctggaccgtcttcgtcggcggggattcgtacgccggtacgaatttctcgacgcggacctcggtgctcgacctgcgcaccggcaggctcgacgcctcgctggaggacttcacgatcctgaaggacggcaagccgtaccgcagcgcggacgtcaacttctggggagtgaccttcgccgccgacgagcggactttctacgcgaccctcgccaccggcggccggacccacctggtccgcggggacctgggcgagcgcaccgtgacgaccctgcgcgagaacgccgagtgcccgtcactgtcaccggacgggacccgggtggtgttcaagaagcgcgtgccgggcctgccggccgaggcgccgtggcggctgtacgccctggacctggcctccggcgccgagaccccgctcgccgaggagcgcagcgtggacgaccaggtcgtgtggagcgacgacgggaccgtcgtctacgccctgccgggggacttcggcgccgacctgtacgccgtggccgccgacgggagcggcgcccccgcccggctcatggattccgccctcgccccggccttcctcggctgaggaggccgcggcgagggcaggaccgtttttccgcttgtccgtccggtggaacgggtcaggcggggatcagggtcttgcggcggcgcttgcgctgcgcgcccgccgacagcctcagctcgatgatcgaccgtacggccggccactcctcgtcgaggatcgagtagaaggccgtactgcggacggcgccgtccagcccccgcgaatgggcccggcggaccccctcgcaggtgaagcccagacgttccatggccgcccgcgaccggccgttgcgcgcgtcggcgcgcagcgagatgcgccgtaccccccaggtctcgaaggcatggcggagcatgagcagcttcgcctcggtgttgatgccggtcccctgggcgcccggggacagccaggtattgccgatctcggcggcatcggggatcgccgtcgccggatcgccgaacgggactccgggcacggcgggccagaccagaggcccctgccagtagtcgagttccaggaaccgggtcgaaccgacgacccgcccgtcggtggctctgaccaccgcgaacgggagcgatcgacccgctgcctgatcggcgagggcacgttcgatgtactcgtgtgacgcctgcacaccgtggggcacgggagtgaaggcgtaagtcgtacgatcctcggccccggccacggccagagcctcggtgtggtggggggcgaggggctcgagccgcacggtgcggcccgcgaggtgtacgggtacgggcacggagccttcggtccttctgggcggtggggtggttgcacagtctgcgtccatgacgtcgccccccgtgcaaaacacgagtgaaaggcaaccggctgtcaggtgaacgcgagtggctcaatgtagctccttaaagtcctctcatgaacccccaatttggcaatggcgcgacaccgatttccgatgactttggtccccgccgcgaagcgcccgtaatcctgatccacggacatcccttcaagcgcacgacgcgagccccccggacggccgccccggcggcctccgccccccgtgcgatcacgtctgacctgcaaggatgcagacgaagtccggtggtcccgggcaaggctccgcgcgcggatcccccggacggatccgccgcccggacggcccgcccggacgtcgaacagatgatcgtcggcggtgtgtccacgaacggccggatcacgggaggggtacgactgcgccacccgggtcccgtacggccccccgcgaggctttgagatcattccggtcatggacgacgtactgcggcgactggccgccgtaggacctttcttcaccgttccgtacgggacgcagccgcccggccccggcttccggccgctctcggcgttgtacggggagcggctggagccgtacgtggccgaggtgggccggcgcatcggcagcggtcccggccgcgtggccgcctcgaccgcgcagttcggcatcgcctcccggctctggtcgctggggctcggctgcgcggccctggcgggccgggtgccggacctggccgccgaccgggtgtggtggcggctgccggacgcgggatcgctccagctgtggctgcccgagcccggccccggcctgccggccgaggcgctcggggagaacgtcctggcgaacctggccgtgctcgacgagggcctgcgccagcgcttcggggtctccccgaaggtcctgcggggcaatgcggcgtctgggctcgtcggcgcgctgcgcgtgctgatcgaccgggtgccgggtggcgcggccgtggagctggcgggcgccctgctggccgacggcggagcgctggagggcaccggcaccttcctccacgaggaggggctcggggtggccttcgtacggcgcagctgctgcctctactaccaggtgcccgcgggcgggctctgcggcgactgcgtcctgcggacggggcggcgggcgggctgaggggcaggcccgcgagggcatcgtgctcacggacgtctggaccccggaaaacgacggtggccaccggggcgcagttgcactgctccccgatggccgtctccgccggcagaacttccggaggactgatcagaaggtcaggttccaggagtcgatcttgccggtgtcgccgccggcgttgtcgttgacccgcagcttccaggtgccgttcgcggcctcggaggaggcgttgacggtgtagacctggttgatgttgtcggtgctgccgcccgcgcggttgtgcacggtgtagacggtgccgtcgggcgcgaccaggtcgaccttgaggtcaccgatgtaggtgtgaacgatgttcacgcccaccttgagggtggccggggcgttgccggtgacaccgctgacggtgatcgggctctccacggtggtgttgtcgccgacggcgaagtcaccagtgttctcgaagtacttgccgggcggcggcgtgctgccgacggccttcagcgcgtcgacctggccctcgccgaagaagccgttcttcgccgtggtgcccttgcagcggctgtccgacgggcaggcgacgtcattggcctgggtggccagcttgtcgcgcagctgcgccggggtgatgcccgggttggtgctggccagcagggccgccacaccggtgacgtgcggggacgccatcgacgtaccgctcatcgtgccgtacttgccgcccggctgggtgctgtagatgccgacggtgtcgccgccgggggccgtcacgtcgacgacgttcagaccgtagttggagtacgaggccttcgcggtggtgcccatcgccgagaccgtgaccacgcccgggagctcggtcgggatgtccaggcaggcgttggtgatggtgcgggtgaccggcgtcgagtcgttcgggctctcgctgtcggtcgtcttgttggccaggtcgacgttggagttgccggccgccgcgacctgcagcgagcccttgccctccgcgtactcctgggcgcgcttgacgccctcgatgatcgcggcctggtcggcgttgtccgggcagttgaactgccacgggtccgtgtagtagctgttgttggtgaccttgaagccgtggtcgccggcccacatgaagccgcagacggtgttctcggcgaagaagagcgaggtgcccggctcggcgatgcgcaccgaggagatcttcacgcccggcgccacgccgatgacgcccttgccgttcttggcggcggcgaccgtacccgccacgtgcgtgccgtgggtgccgacgtcccgccaggcgcccgtacgggtgtccggcttgccgtacgcgcaggacgcggagtccgccgcgttgaagttcggggccaggtcctggtgctggtcgtccacaccggtgtccaggatgccgaccttgacggaggcggagccggtggtgacggcccaggcctggtcggccttgatctgggtcatgtcggcgcggaccggctcgcccgaaggcgtcgtggcctgcgccgggttggcgggcagcgccgggttgtaggcgtccgccggcacgtccgaggtgcgggtggcgccgacctgctggacgccgctgacaccgcgcagggtggtggcgaagttcgcggacgcggagtgggcgacgatcacgccgatcgcgtcgtagtactggaacaccgtgccgctgttggcggtcaccgcgttccgcaccgcggtggtgtcaccgggagcggtgatcacgaggtaggcgcgggtaccggcaacccaggtcgcactctgggaagtcggggccgcagccttgggggccgccgcgggggcgggggccgaggagccgttcggcgagacgggggcggtgccggcgagcgcggcgggagccccgaaggcgagtgccgcgccgagcgtggcggccagcacgagggtacgtcgaggtcggctggatatgtggggtatcaatgcgtcctccgaagacccggtggtcaggccgggtcgaacgaaacaagtggtggacgcaagatgtcatgcacacagcctgttacggaagtaccttttacagcctgggggttcggttatcggtggccgaataccgactatgggtgcaagtgcggagaatgcggcgggccgaccgggctgggcaccgtgggggcgagccctgcccggccggcccgtgcgggcgggaccggctgggggaggagtcctagaccggcacgccgtccttggggtggtgcgacgggaccggagcctcggccggcgccgtgtcggacccggccggccgtgccgcggccggctccgtcaccgcacgctccgcgccgtgtccgtcgtcgaccagtgtgctctcgtcgaacggcagccggccggcgaggacttcggtggcacgcgcgcggtcgaactccttcgtccaggtcccgatgaggaccgtcgccacggcgttgcccgcgaagttcgtcagggcccgggcctcgctcatgaaccggtcgatgcccacgatcaggccgaccccgtccaccagttccggccggtgcgactgcagtccgccggcgagggtggccaggccggcgccggtcacgccggccgcgcccttcgaggcgatgaccatgaacagcaggagcgagatctgctcgcccagcgccagcggcttgcccatcgcctcggcgatgaagagcgaggacatcgtcagatagatggccgtgccgtccaggttgaaggagtatccggtcggcacggtgatcccggtgacgggccgggagacccccaggtgctccatcttggcgatcagccgcggcagcgcagactccgaggaggaggtcgagaggatcagcaggaactcccggcccagatacctcagcagtgagaagacgctgaccccggtgcacacccgcagcagcgtgccgaggaccacgaacacgaagagcagacaggtcgtgtagaagccgatcatgatgacggccagggacttcagcgcgtccatgccggtggccccgaccaccgccgcgatcgccccgaaggcgcccaccggagccgcccacatgatcatcgccaggacccggaacaccagcttctggatgtgcccgacgccccgcagcaccggctcgcccgcggcgcccatggcctgcagcgcgaacccgcagagcagcgccaccagcagggtctgcagcacctcgccgccggtgaaggcggacaccagcgtggtcgggatgatcccgagcaggaactccggcgtgctctcggccccgcccgccttggcctgggcctcgcccgcactgcgcgccgcctcggtcaggtgcagcccgctgccgggctccagcaggttgccgaccagcagaccgatggccagcgccaccgtggacatgaccatgaagtagccgagggcgagcccgcccacggcgcccaccttggcggctttgcgcacggatccgatgcccagcacgatcgtgcagaagatcacgggcgagatcatcatcttgatgaggttgacgaagccggtgcccagcggtttgagctccacggccacgccgggggcggcgaagccgacggcgatgccgagcagcaccgcgccgatcaccgcgatgtagagaaagtgcgttctgtcgcgcctggcggccacgatgcctcccggtggtgattacgttcggggagaccatcgcccagggctgtgaccccggtcacccttgcgttcattgagttcacgacccggtgcacactgagcgccatgttccgcttcccccggcccccgcgcagtctcgccggccagctcttcgccatgcaggtgctgctggtcaccgtggtcgtcgcgggctgcgccgtcttcgcgtacgccaccgcccgggggcaggccgaggaggccgcccgccgccaggcgggagccgtggcccgggcggtcgccgactccccgtccgtacgcgaggccgtacgcggggcggcgcgcgggaccgacccgtccggcgcgctccagccctacgcggagcaggtccgggcggactccggggtggccttcgtgacgatcatggcccccgacggacggcgctggacccacccggacccgcgcaggatcggggagcccttcatgggcaacaccgcccccgcactgcgcggcgagaccttcagcgagacgtacacgggcaccctcggcccgtccatccgggtggtcaccccgctccgggacggggaccggatcgtgggcctggtgagcgcgggcatcaccgtccgcgccatcagcgaccggctcgccacgcagctgtccgccctcgcctgggtcgcgggcggcgcgctcgccctcggcggcgtgggcacgtacgtcgtcaatgcgaggctgcgccgtcacactcatggcatgaacgcggcggagctcagccggatgtacgactaccaccaggcggccctgcacggagtccgcgaggggctgctcatgctcgacgggcagcgccggatcaccctgatcaacgacgccgggcgggaactgctcggcctgccgggcggcgagatcaccggcacccgggtcgccgacctcggcctgccggccccgctcaccggggccctgctcgccgaccgcccccgggtggacgaggtgcacctgaccgcggaccgggtgctggtggtcaacagctcgccggtcgcgggcggcggccgccggggcaccgtggtcaccttgcgcgaccacacggaactgcaggcgctgaccggcgagctggaccacgagcggggcttcacccaggcgttgcgctcccaggcccacgaggcggccaaccggctgcacaccgtggtctcgctcatcgaactcggccgcgcggacgaggcggtcgacttcgccaccgccgagctggaactggcccaggccctcaccgacgaggtggtcaccgcggtcggggagccggtactcgtggcgctgctgctgggcaaggccgcgcaggcgcacgagcggggcgtcgagctggtcgtgaccgccgacagccgcagcctcgccgacggcgccgggctgccgccggcccgggacctggtcaccgtgctcggcaacctcatcgacaacgcggtcgacgcgctcacggccgtacccggggcccggatcgccgtgacgctgcggccggagccggacgagctgctgctgcgggtcgcggacaacggacccgggctgcccgagggggtggacgtcttccgccggggctggtccggcaagggggagggccggggactgggcctcgcactggtccggcaggtggcggagcgctgcggaggcgcggtgatcgccgcgcagggcccgggcggaggcgcggagttcacggtccgcctgccgatcgggtccctgcccggcgcggagccggagggttcgcggtgagcggcggcgaggtgcgcgtcctgatcgtcgaggacgacccggtggccgccgacgcacacgcgctctacatcggccgggtgcccggcttcaccgccgtcggcgccgtccactcgctcgccgaggccacccggttcctggagcggacccgcgtcgacctgctgctcctggacctcggcctgcccgacgggcacggcctgcgcttcgcgcgcgggctgcgcgccgccggacatccggtcgacgtgatcgtggtgacctccgcgcgggacctggccgtggtccgcgagagcgtctccctcggcgtggtccagtacgtactgaagccgttcgcgttccccaccctgcgcgaacggctcctgcgctacgccgagttccgccagacggcgggcgaggcggtcggccaggacgacgtcgaccgggcgatggccgcactgcgcgcaccccgcccggccgagctccccaaggggctgagcgcgccgaccctggaccgggtcgccgccctgctgcgggcggcgcccgaggggctgaccgcggcaggtgcggccgaggcggccgggatctcccgtatcaccgcccgccgttacctggagcacctggtggacaccggccgtgcggaccgcaccccccggtacggccaggtcggccgccccgaactgcactaccgctggctggcggcggccggttcggtgtcgaaggtgtagaacttccggtggtccagcatgtccgccggagtcacgttgttccacggccgcatcgtgtcgttcaggtcgacgacgttctgcgtgcccgcggccggcaggtacgtggactgggggtgcttggcctgccagtccgcccacagcttgtcgatgaaggcgtggtgcatccagaacaccgggtcgttgggcgagaccccggtggacatctgtccgccgacccacacgtgcacccggttgtgcaggttggcgccgcgccagccctccaggttgttgcggaagccgttggaggagctgttccagggcgccatgtcgtagaccggcatggcgagtacggagtcgacctcggccttggtcggcagctgggcgacggccgtgccgaggtcacggcgcaggtaggcgcgcccgtccacccggacgtttatgttccacttgcccgtcgagtatgcgaacggaccgtccatgacctgcccgtcgcgggcccgcccggtgccgccgaggaagtcggcggcgaagagggaggcgcgggaggtccggtccacggtccagtcccagtacgggagcgcgacgctcgcgtccactttctgcagcgcctcctcgaactccaggaggaagcgccggtgccacggcaggaaggacggggagcggtggccgacgcggtcgcccgagtcggtgtcgctcatgatgaagccgttgtgggtggtgacgaagcggtcgtaactgccggtgcgcttgagctccagcagcgccgaggtgaaggcgcgcttctcctcgggggtcagcgtggcctggttcttgcgtacggtcatgccgcacctccgaaggggacgagggcggcgccctggagatcgcggaccgcggcgcgggcgaggagcttcgggtcggcgaaggtctcgtagtggttgatgacgctgatccaggtgccgtcggcattgcgcatgatgtgcagttcctggccgtctattcggacggtgggctgaccgggcgagtggtggccgccgtggtggccgcctccgccgggggtgatctggatgcgacggcccttgtagacctcgtcgaccgtgcccggggtggtgggctcggtgggggtcgcggcggcgctcgtggcgcccgcggcggcagcggtcaggccgaggacggtgagagcaccggcagttgtccccagggcctgacggcgagtgatcttcttcatggcccgaagaggtatcagggctcaggggagggttggcctgtatccggacatccctggatatgttgcggatagaacaagttggatgatcttcccgtccggagcggctccgggggtccggacgggaagatctgcgggccacactctactcggcagtaatttctcctgcgtcaagggggccctatgtgcggggtcacactgcagagtcggctggaagcagagcgtcaggcccgggccgggagcgtacgaggtgacgccgggatggcggggtccgggacctccggaagatccttgatgaacacgaccccgtcgatcacgcccaagtgggccgcgtcgagcggggcgtagccgaaccacggggagacccggggcgcgggcggcgcgtcgccgagtgcggaggccagccggccggcgtcgacgaggcggagctcgtcccggagtgcgtacagaaggccttcgacgctgtccggcggcggagcgtccacaccccggtgccggatcgtgccgagggccgtggccacgaacgcgtactccgcgcccagccgggcgctcaccagtgccccggcgctccaccattccaaccgcacgccacccatccgcatcgagctcttctcccgctgcagatgggcgttgtgggcgtggacgaggaccgggccccgggccgccagcgcgagcaggttgtccgccatcatccggccccgcacgcccaccagccgggtcatccgggacggcgaggtgtcggccatcgagtggtggtagcgcagcaggccgacggcggagcgtccgaacaactccgcccgctgcgagtcctccccggattccgtgacggggtgcggcagctgctccgccagcagcgccaccagatcgtcggcgagcagccggagctcacgggcctcggcggaacgccccgtggaccgcgcggggtccgtcatcgcggcgggctcggtccaccggtcgtcggcgccgagcaggcggtcgagcgtgtccgcgctgcagggcaggaggccggcgtcgacccggcgggcgaggtgggcgtggagcgcggtgagcgcctgccgggggctcgcggcgcccgccatctccagcgggccgtcgaacccggcgaagcgcacccgctcggacgcgggccggccctcgttgaacgcccgcatccagcggacgagttcgcgattggcgggggaggcgccgaacccgtggctgaagccgcgctccatgacctcgtcgagacgtccggtaccccaggtgacgtacgcgtcgacgagcaggcccgccaggcagtcgctctcgatcgcgatggtgcggtagccctcctgtacgacgagctggcggaacagctcgttgcgcactcgaagcagtgagtcctcgccgtgggtgggctcgccgagggcgagcagtcgcggtcgcgccgcgagcagatccatgaggccggcggcgtcgaccgggcggacggtttccttcacgtcagtgatgtcgatgggcatgccttcaacgctatcgttgaagcttcggtggaaacttttccgctctatcgtggggtgggtgacccgaaaccttcaaagcggctgtcggctgaggccgatcgacctggcgcgcgggcacggactgtccacgcaggcgatcaggaactacgaggaggccggcatcctcccggccgcggaccggaccccccacggctaccgcgcctataccccgctgcacgagcgcgccctggccgcgttcctcgccctcgtgccggggcacggccacgggacggcggcatcgatcatgcgggccgtgaacgagggcgcggccgacgaggccttcggcctcatcgacgggacccacgcccagctgctcgccgaccggcgcaccctcgaagccgtggagaacgccctgcgcgacctggcgtcggccgccgttgccgaccgccccgcggccacgggctcggcggccacgggccccgcggccgccggctccacggcgggatccggccccctgttcatcgggccgctcgcgggccggctcgggatccggccagcgaccctgcgtgcgtgggagcgggccgggctggtccgcccgcgccgcgatccgctcaccgggtaccgcgtgtacgacgaggccgacgtacgggacgcccgcatggcccaccaactccggcgcggcggctacctgctggagcagatcgcccccctgctcgcgcaggtccgcgccgcgggcggcccggaacccctggagtcggccctgaccgcctggcgcacccgactctcctcccgcggccgcgccctgctgacgggcgcggccgccctggacgcgtacctccacgccaggggctgaaggggagccgtccgcgccccggcggctaccgggcgccctcgccgccgggctcgcgggcgggttcgcgggcggaaggagccgcctggagggcctgtgcccgccgcctcgggtcgtagtcggggccgacgccctcgatcagcagcagatcgccctcgatgtggtcggtgcgcaggcgcacgatggcccggtaggcgggggagtcgtaccaggcgcgggcctcggccaggccggggaactcgatcagcaccatgctgccgggccatgagccctccacgacctcggccggaggtccgtggatgacgaagcggcccgcgaaggggtcgagggtcgcctggatgcggtgcaggtactcgatgacgtcggggtggttgcggcggccgcggagatgggcgaaaccgtaggcgggcacgacggggctccttcgttcctgtggcggcggtgggtgacgggcgtgaacgtagccgcgcggaggcggtcccggcgattaccccggaggtaatcgccgccccaggcctgcccgcgaatggcatttcatgtccctatagtgcggatatggctcttcatgagacgaaggacgtacgcgcccaggacgccgacacggacgtgttcgcgtccacgctgagtggccagatcctccccaagtacaggattcccgaggaccactcacccaccgaggtcgtctacgaactgctgcgcaacgagctgctcctggacggcaacgcggcccagaacctggccaccttctgcaccacctggtcggacgagggcgtgcaccgcctgatgaacgcctgcctcgacaagaacatgatcgacaaggacgagtacccgcagaccgccgagatcgagtcccgctgcgtcaacatcctggccgatctgtggaacgcccccgccggcaccaccgcggccggctgctccaccaccggctccagcgaggccgccatgctcggcggcctcgccctcaaatggcggtggcgcgagcgccgccgcgccgccggtctgcccaccgaccgccccaacctcgtgtgcggcccggtccagatctgctgggagaagttcgcccgctacttcgacgtcgaactgcgccaggtcccgatcgaggacggcgccaccggcctgcaggcccatcagctcgctcagtacgtcgacgagaacaccatcggcgtcgtcgccatcctcggcgtcacctacacctgcgactacgagcccgtcgccgagatctcggccgagctcgaccggatccaggccgagcacggctgggacgtccccatccacgtggacggcgccagcggtgggttcgtcgcgcccttcctccaccccgacgtggtgtgggacttccggctcccgcgcgtcgcctccgtcaacacctccggccacaagtacgggctcgcgcccctgggcgtcggctggatcatctggcgcaccgccgacctgctccccgcggacctcgtgttcacggtggactacctgggcggtgacatgccgaccttcgccctcaacttctcccgccccggcggcgaggtcatcgcccagtactacctcttcctgcgcctcggccgggccggctaccgcagcgtccagcaggcctgcgccgacaccgcgcagtacctggccggcgagatcgccgcgatggggcccttcaccctcctctacgacggccagggggccctgcccgccgtctcctacaaactcaccgacccggacgccgcccccttcaccctctacgacctctccgaccggctgcgcatgcgcggctggcaggtgccctcgtacccgctgcccgccgaccgcgacgacaccgtcatccagcgcgtcctcgtccggcacggcgtgacccgcgatcagatggccctgctcatcaccgacctgcgcgccgccgtggaacacctgacggccacgcccccgcccgtaccggccgccgagccgcggtccggcttccaccactgacccgcgtccgccgtgccgtgacgggcaccggggcaagggctcccttgaacatcctggtgcgcgcctgacactgtggtgatcatgagtgaggatttcgaggagcaccggcgcctgctgttcggcacggcctaccgcatgctgggcagcgtcgccgacgccgaggacatcgtgcaggacgcctggctcgcctggcaccgcgccgaccgcacggccgtcgagaacccccgcgcctatctggtgcgcaccgtcacgaacctgagcctcaaccggctcaggtcggcccaggtcgtccgcgaggcgtatgtcggaccctggcttcccgaacccctcctcacctcgcccgacatcgccgaggaagccgaactggccgacaccgtctccatggcggtcctggtcgtactggagaccctgacccccaccgagcgcgcggtcttcatgctccgcgaggtgttcggatactcctacaccgagatcgcggaggtcgtcgggaagaccggggcgagcgtccgccagtgcgcccaccgggcccgcgaacacgtccgggcccgccgcccccgcttcaccgcccaagcggccgagcagcgcgagatcgtcgagaagttccggcaggcctgcctcggcggggacctcggcgaggtgctcacggtcctcgcgcccgatgtcgtctcctgggccgacggcggcggcgtcgtcacggccgcccgccggccgctgcgcggagccgaccacgtcgcccgctggtggctcggcgtcctcgccaagtccgaggtccgcgacggggcgatgcgcccggccgagatcaacggcgagccgggcctgctgctcgtccacaacggcacgaccgtcggcgccatgaccttcgaggccgccgacggccggatcaccgcactgcgcgtcagcgtcaacccggagaagctgcggggcctgcggccctgacgcgggggccccgcacccgccgggagacgcgaccgcgctctaccgcgcgccgaagttctgggtccaccagggcccgcccgaaccctggtggatgcccacgccgatgtccttgaaggagcagttgaggatgttcgccttgtggcccgggctcttcatccaggagtccatgactgactgggccgtctgctggccccgcgcgatgttctccccgtacgtcgaccagcggtacccggccgcggtcgtccggtcgcccgggtccttgccgtcggggctggtgtgatcgaagaagtcccgggccgccatgtcgtcggagtgcccctgagcggccgcgcgcagctgcgtgtcctccttgagggggccgcagccggccgccgcccgctcgctgttgaccagggccacgacctggccggccacgcccgacggcggggcgggcgccggcttggccggggaggccttcgggctcggggacttgctcttggactgcgtcgggctcgggctcgccgacgggctcggcgaggcggaggccgacgcggagggcgagggggacacggagggggaggccgactccgggggcggagcggcggattcggtcgccgagagcgcggccagcggggtcgcgggcgccgcggcgccctccttcgtaccgccggaaccggggagccccccgaggtacacgagcccgccgcccgcgacacaggcggcgaggaccgcaccgccgaccacccggcggcggctctgccggcgcttgcgcagcgcgccgcggccgccaccaccgccaccaccgcccacgtcggccaccggggtgagctgggtcgccgcctcgtcgaagccgccgccgaagccgccgcccgggcccccgtcgacaccttcggcgaaggcgacgctcgcgggggcgaagccggccgccccggccgtcttgaaccccgccagcagggccgccgagaccggtaccagggccagaccggccagcagtccctccgccggaaccagtccgctccacagaccggagcaacgtacgcattcacgggcgtgccgggctattcgcttgcgccacagtgccgagggctggccgtcccagcccgccatcaccgtccgcagctcctcgcacgccgggtgggtgtccagcgcgcgttccaccacgcgggccgactccagctgcgccttcatccgctgcacccgcaccgccgtgtgctgcggggacagttccagcgcgcccgccacctccgcccgggtcagttccccggcgcactccagccaccacagcgacagcagcgcccggtcctcgggctccagccagcgggtggcgcgggccgtctcgcgccgctggccggcgaggtggaggcgggcgacggtcaggtcgacgaagtccgcgccggggtcggccacatcgctcgcggcctccagggtgctctcgccgaagccgctctgccgggcctgccagtgcgcccgtacgcggttcatcgcgatcgccaccagccaggaccggaagctctcgtccacgcgcaggccgcccagcccgtcgagcgcccgcagcatcgtgtcctgcaccacgtcgtccacgtcgcaggacccgttgagggcccgcccgacgatgttgtagacgagcgggagatgggcgccgacgagctcgtcctgcgcgcgggggtcgcccgcgcgagccgctgccacgagcgctgcggtgtgctgagtagccatgtgatgttccctgtccgtaccggcggtcgatgatgcccgatacatgggagaccgtcgacgggggcgtcgataacagttatccggaagaattttcccgaagacttctccgggcccctccaccgggggtcagagcagcggagccagggcgagcgcggcggtgcgcagggccggtgcgtacgcctcgatctcctcgcgggagaccaggaaggtgacggtggtgacgctcaccccgccgaccgggcggcccgccggaccgaggaccgccgcgccgatgcagcggatggtggtctcgttctcctcgtcgtcgagggcgaagccctgctcccggaccgccgccagttgggcgtgcagggcccgtgcggtcgtgagcgtccgcggcgtccggcgcggcagcccggtcgcgtcgatcagttcccgtacctcctcggccggcaggtgggccaggatgctcttgccgatggcggtcgtgtgcagcggcatgcgcatgccgacgcgggacgccgtccggaacggctggccgtcgctctccagcttgcggacgcaggtgatgttccgcccgctgtgcagggccagatggaccgtctggccggtggcccgccggagttcgttgaggacgcccccgacgcccgccggttccccggcgccgaccagggcggacagcccgcgcagccgtggccccaccgcgtaccggctgtcggcctcctggcgcacgaagccctggtcgatcagcgaggccaggatccggaaggtgctcgacttgggcaccgcggccgcggccgtcacctcggcgaggcggtgcgggccgccgggcgcggccaccgcctccaggacgcgcagcgacttctccagggcggaaccggccgcggaagtccgccccgtacgtccgcccgctgacgttccgtccattgacacgagcgctcctggcatgggtagggtctagaccacagggttccgccatacggtacgccgttccactacgtggaacaatcctggagcgaagggggaggtccgttgcccggccacccgtccgaccatccctacgccgtgctggccgcccagcgcgtgctgcccgtgctgcgcgaggccgacgccgacgcggcggtcctccgcgccaccgccctgctcgccgccgggtgccgcgcggtcgagctcaccacgtccacccccggctgggccggagccgtcacccgcaccgccctgctgagcgacgtccacggccgcccggcgctcatcggcgtcggcacggtcaccaccaccgcgcaggcggaggccgccctggacgcgggcgccgccttcctgatctccccctacccggcccccgaggtccgtgccgtcgccgttcgccgcgaagccgtcttcatcgagggcgggttcacccccggcgagatcgccgccgccgtccgggccgccggttcggccaaggtcttcccggcgcacgtgggcggacccgggttcgtccgctccctcagggccgtcctgcccggggccgtgatcatccccaccggtggcatccggcccgccgaggtccccggctggctcgccgcgggtgcgacggccgtgggcctcggcgacggcctgccgtccgacccgggcgaactggccgccgtgttcgccgcggcggccgtgccgtacggcgtgccccgcgccgcggggcactgagcgtggccggacgagccgccgcgcgggccgccacgcggggcgacatgcgctacgacgtgctcgtactcggcgaggtcctggtggagatccacgcgggcaccgccctgcgcgatgccgccgccggcaccccggcccgtatctcctactccggggacgccctcaacgcggcggccgccgcggccgccgccggcgcccgtaccgccctgctggccgtcgtcggcgacgacgagctcagcgtcccgctgctgcgccgggccaccgggctcggcgtggacgtctcgcacatccgccgggccccgcaccccaacggcgcctacctgctctccgccgacaccgacggcgaccgggagttcgtctactggcgcacccgcagcgccggatccaccctcgcgccccggcacgtcgcctcctggcgcgggctgctgacccgctgcggagccctggtcaccagcggcatcaccggcgccctgtcgccgagcagccgcgacgccgtactggcagccgcccgcctggtgcacggggcgggcgggcacctgacgtacgaccccaacttccgctcccggctcaccggccgggccgaggcgcgcgagctgctggcccggatcgcaccgctgaccgggctgctcaagacctcctgcccggccgacgcgctggccctcgtggacaccgcggacccgcgtgccgccgccgcccgctgccgcgcgctgggcgcccgtacggtcgcggtcaccgcgggcgccgaccggttgctgctgcacgacggctcgggggccgtgtacctgcccgtgccggtcaaccccgagccggtggacgcgaccggtgcgggcgactgcttcagcggcaccaccaccgcgcggatcgccctcggcgacaccctcacggacgccgtggcctacggcgtggccgccgcctccctgtcggtgtccggccgcggcggcaccgggcgcgtccccgccttcaccgagaccgtggcgctggccgccgcgcaccgacgtgccttccccctttgaccgccccgtccggatcggtgacccagcccgcggcgaggacgagccgcgaggcccggtggacggccaggaacccgaacggccggtcgaaccggacgtccgcccggcggacccgccggttcgcggggggccgtgccgcgccgccgaagcgccccacgacggaagtgacggcggcggcctcgaatcccgtcgcgtggaaccgggccatcgcggactgccgggccgaaccgatcgccagcggctcggaactgatcccgcggaagtggccgcggtccgcgtcggtggcggtggccagcccgaacagcggggcatggtcgagcagatcgtggtcggcggacagcgagaacgccacggcgtggacggtcagcaggtccaccgggtagggcgagtgctcggtacggatggtcagcccgggccccggggttccgtcggggagctcgctgccggggagggacgcggcggcgccggtgacggcggcgagacccgtccgcagcaccgagcgggacggtgccccgggttcgccgagcagcagatgcacgtccacgtcctcggcgccggccacttccaggacggtgacgggtccggcaggcccgtcggccacccggaccccgtccagcgaacgggtgctccgggacagccgtcgcaggacccgcctcgcccaagggccctcggccatcgcgaggggcgtctcccggaagggctcggcccaccgcacccggagcgccagcgcggaggccaggaccaggcaggagtccccgggccacgtcaccggcacgtgctcgatcagcccgccggtccgctccgccgcccacgcgtccaacgccctctcgtcggcgaacggcacaccggtcagcgtgccccgggcgcccgcgggcagcctcgacgaccagtcctcctccagggggagcccggcagcggtccacagccccgtcgccgcccgcaggccccgtacgccggccagcgcggccagcagctcccgtgccgccccggccgcggcgtcggcgggtatgtccagggcctgcgccagctcggcgcgggcgggaccgctcgcgccgtcggcgagcagggcgagcaggggccagaccccggaggccgcgaagaccgtccccgtgtcccgcgcgagggcctgagcggcccagtgtcccgtgaggcggttgaccgcccgtaccgtctcggtcttcatgcggccgagcgtatgtggagggcgccgccgggccggatggatttccgcggcccggcggcgccggtcaggggtcgtgcgggtcgtgcgggtcggcgcggaccgggtcagcggccgcgcaggccccggtccacggccgtcatcagctcgccgtccgaggtgtccgcgtcgagggaccagaacatcgcaccgccgaggccgtgttcgcggatgtacccggtcttggcgcgcagcacctgcgggtcgtcgtacgtccacagggtggtgccgtcgaagagccaggcgtggcccccgcgccggtcccggtggaccgtgtaggcgccggagtcggccagcttcttcagcgccttgtagtcctcgtacccggcggaccaggtggccggtgccggcccggtggccggctgccccataccgtccccgccgccgctgacgccggtccagccctgcccgtagaacggcatgcccatcaccagcttgtccgcgggtgcgccacgccggcgccaggcgtccaccgtgccgtcgacgctgaagtcgttccgggcgtggagcgcggactgctgggcggtcctcggctcgccggagacgtggaagtcgtagccctggagggtcacgaagtcgaggtcgcgcatgatccggcggacgtcgaagcccgcgtcgatcttggcgggggcggtcgggacgaaggccgtcagctcgtacgaggtcttcttccgctgactccgcgcgtacgcgtcgagctgcgtgcggaactccttcacgagcgcggtgaagttctgcttgtcctcgggccggtacgtcgtgtcggtgtcgcccgcggaaccgggccactcccagtcgaggtcgatcccgtcgaagacgccggcggccgctccggccccgccgcgagcgccgtcctgcggcaggttgcccttgatgtagaggtcgatgcaggactcgacgaaggccttgcgggaggccggggtcagcgcggcgtccgagaagtgcgtggaccagctccagccgcccagcgagatcagcaccttgagtcccgggtgcctggccttgagctcgcgcagctggttgaagttgccggcgagcggctgctcaccggtgtcggccaccccgtcgacggagttcgcggcgtcgagcgggcgtacgtagtcggcccaggcgtcggcctcgccgggcacgttcccggtgaagcatgtgccctgcggactgacgttgccgaaggcgtagttgatgtgggtgagctttccggcggagccgttcgcctccaggtcctggacctggaagtcccgcccgtagacaccccattgggtgaagtagccgactttcctgtacgcacggtcgtggccgccgccgtcggcctgcgcggcggcggcgggcgcgaaggcggtcagcagggagagggaacaggcggcgacggccagcctgccgagcatgctgcggcgcatgggcttcctttgcggatgcggggagcggggcgtgtgcgcgtgcgctgtgcatgccggaaactattggtctggaccagagtggtcaagggggcggccgaaacatccctacgcgagcgggaggctccagtggcccacgtcgtcggcgaggccggtgtcgagggcgaactggacggcggccggttcggcgccgaccgggatccggaaggtgatgaatccctccgccgaggcgccggggccgagcgcgacggttccggggaagcccggtccggcggtgatggcggtgtcggtcccggtgaaccgccggcccgtggtgtccagcaggtgcgcggacggcgcgggggagtcctcgtacacggcggtcccggtgttctccaggctgaagcgcgtcgcgacgagccggtcgccaccggcggactccgggccggtcgggctcgccggatccaccacccgcgtcaacgtgacgtcgagccgcaggccgggctcgttcccggccagggagatcgtctcgcccgagccgtccggggccgcgccgagcagagcgggtgcgaggagcgcgagcgccaggagcgggccccgcaggcgccccggccgtcgacttcggggcatgacgagacctcccgctccacgggtccccccacttacgatcctccgcaccccgcggccctgccaccgggcggtccgggccgcgtccggcctccacggcgtcggcgtggtcggccccggcgtccacaccgccgggaaactcgcacccgttcgggtcggcaattgattggatctcggggccgggtcgtgccatggttggtcccaccgaaggggtgtagctcagctggtcagagcgccggtctccaaaaccgaaggccgcaggttcgaatcctgccgcccctgccacaccgacggcacggctgtcgggagcgcccggccgagagcatccctcccggccgggcgccgctgtttccccggcgcgccggtggccgtcatggaacggacggccgtcacagggtcatgaggtgggccgccagtacgaggggcgcggggcaggccagggcgcccagcagggtgagacgggcctcgcgcgacagccgccggactccgggggcgacgtacagcagggcgcccaccagcgccgctccgaccacgatggcggcgacctggagcagcgggcgcgtcacgtcctcgccggccgccatcccccagacgccgatcatcagcacgaagaagccgatgacggcgagggacagtccggtcagggcccacagcaggacggacgccacgacgagagccttgttcggcgggacgggtcgggcgggcgcgaagggcgttgcgggcatggccggctcctgttgctgactcggggtgatgatccaagtctgcggggccggcggcgacgggggatgagtaggagtacccatcccccgcggcgcccgtgctcagccggaactactcggtgcccggctcctggtagccgtacggacgcgtgatgatctccatgccgtggccgctcgggtccgtgaagtagacgccgcggcccccgtcgttgtggttgatctcgccggggtgccggccgtgcgggtcggcgaagtacggggcccccgccgcccggatcctctcgaacgccacgtcgaactccgcctcggagaggaggaacgcgtagtgctgcggggtgatggactcggccgggatggtcgcgaagtccagggtgacgccgttcccggtgtccacggggatgaagggaccccactgggtccctacctccagtccgaggacgtgtgccaggaaggtggcggactcccggttgtcacgggaatggatgatcgtgtggttcagatgaacggacatgagtgaatgcctccgaaaggcacgtcacgggcgcctccatgcctcacccggtcggtgaccggcacgcgatgccgtgatcacgatcctaggcaacccctcccggcgaagtccaccccgtccgccccgtctcccgcggtccccgcctcaggaactcccgtacaccgccttgacgttgtcctgcgccgggtgcgtccggccggccgggcccgtcgcgaacacccgcaggaggttctccgtcacccgcgtggtcagcgcccccgagcgcgcgtccaggccgtggttgcgtccgctccggccgtcgcccgtcgcgtccagggcctcgacccaccgcatcgtgccggtcgcgaacacccccgccccgctcggcgccgtgtagtaggccgtgtcctggtggctgggccgcccctcgcacaccacgggggagtgggccaggatctcgatcggccgcggggtcgggaaaccggtgtcgaccttgtcgtactcgaccccgaccaggtgctcgaagcggtcgccctcccgcgcgccggtgccctcgaagagccagtgcccggggtgggtcaccacgtagggggcgtccaccggatagccgtcgtagatcacaccgagcagcgagctctccgggtccgcgccgggagccgagcggaagtccaccgtcgcgggatggccgcgcctgaagcccgggtcctgcgcgtaggacgacttgtagcagaccagcgtacggtccggccccaggtcggaggcctccagccggatccggcggtagcagcagttcgcgcccaggactgcgatgttggtaccggcgtcgcgggcggcggtgacatgggcccgctgctccggcgaccagtactcgtcgtgcccgagcgagagcaccgcagtcgccccctccaggagccgcttctcccgtgccacgtcggtggtggtcgcgtaggcgaggggtatgccgagccgctcggccagcgcgatcagcggagcctcgtacaccaggaacaggcccgcgccgtcgtcgtactcgtacggccggtcgaagctcacggcgagcgagcgcgaggcgaagcccccgccggggccgtcgtagctgccgtagccgccccaccggttgtacgcctgccaggtggccaccgcgttgaccacgaccgtacggccggcggtcacggcggaccggacggtgagcggtacgaagcgccgcccctcgccgccctgcgcgtcgagccgcagcaggtagctgccctccggccagtccttcgtcgcgaccgtggcggtacgggtccaccgcgtgcggaccgtcctggtcccggcgtccaccgtgggctccggctgccgggctccgggcagggcctcggagcgccacaccagccgcgcccgggccccgccgtaccagcccatccggtaggcggagacggtgaaccggggcgctgtcgtggagacgtgcagcccgaaggactcgcccggcaggacgctcaccctgtccgcgaacccctcgatggcccgcgccgggccggccgtgaccaccggccagtcggggtggcccgggagggcgttctccgccttgacgtcgagaccgcgcgccccggccgcgggcggcttcccggcgcgcgcgtcgggctccgacgtcgccccggaccccgccgcgggtgggccgtcgccctgcgcacagccggtcacggccccgaggcccgccgccgtggcagcccccgtcgcgatcgcgaggaaccgccgcctggcggcgccttcgccttcgcctgggcccgcgtgctcgtggtcggcggcgggcccggccgtgtactcctgatccatgcggggcacgttatgtgacgcttgggcccacgcttccaccgccctgccaggtcccgtcgccccgccccgagtccatggaacggctcggacagagccaccgcctgatccaccaccgcgttctcgaaccggagcgccccggcgccgagctgccgctgcgcgaacagcccgacctcggccgccccgaggccgccccacactccagtgagagacttcttcccgtgaagcgcacgagcacccgcctcgccgacggccgcgagatcttctactacgacgccggcggcgaggccgcccgtaccgccgtccgcgccgtcccggacacccgtcccctggcagccccgcccgccgggaccggccccgaggtacggcgcgatccactgctcggcgaccgggtcgtcatcgccgcccaccgccaggaccgcacctaccacccgcctgccgacgcctgcccgctgtgcccctccaccgagggacgcgcgagtgagatcccggcccccgactacgaggtggccgtcttcgagaaccgtttcccctccctctccggcgacacgggccgctgcgaggtcatctgcttcacccccgaccaccggacctccttcgccgagctcgacgaggagcgcgccgcgctcgtcctcgccgcctggagcgaccgcaccgccgaactctcggcccgcgaggacgtccggcaggtctactgcttcgagaaccgcggcaccgagatcggcgtcaccctcgcccatccccacgggcagatctacgcctttcccttcgtcaccccgcgcaccacccggatgctcgccaccgccgccgcccaccgcgagcggaccggcggcaacctcttcgaggaggtcctggcggccgagcgtgccgaggccacgcgcgtcgtcctcgaaacggagcactggaccgccttcgtgccgtacgcggcgcgctggccgtacgaggtccacctctacccgcgccaccgggtgcccgacctgcccgccctcggcgacgcggcccgcgccgacttcccccgggtctacctggagctgctgcgccggttcgaccggctcttcgaccggcccgaaccgaccccgtacatctccgcctggcaccaggccccggcgggcgagggccgcgcggacttcgcgctccacctggagctcttcacgatccgccggaccgccgacaagctcaagtacctggccgggaccgagtccggcatggaggcctacatgaacgacgtccggcccgaggccgcggccgcgcgactgcgggaggtggcgagcgcgtgagcgggacggcccaggacgacttccggcagctgtacgggtacccgcccgagggggtctgggcggcccccggccgggtcaatctgatcggcgaacacaccgactacaacgacgggttcgccctgcctttcgccctgccgcagcgcaccgaggtggccgccgcccggcgcaccgaccggatcctgcgggtccactccgccgaagtcccctccggcgcggtcaccctcgacctcgccgagctcgatccggagcgccctcctcagggcgccgcgagctgggccgcgtacccggccggagtcgcatgggccctgctggacgccggacttccggtcgggggcgccgatctgcacgtacggtccgacgtgccgaccggcgccggcctgtcctcctccgccgccctggaggtggccaccgcgctggccctcaccgacctgtacgggatcccgctcacccgcaccgacctggcggccctcgcccggcgcgccgagaacgcgtacgtcggcgttccctgcggggtcatggaccagacggcctcggcctgcgcgaccgggggacacgccctccacctggacacccgcagcctcgaacagcgccacatccccttcggctgcgaggcggccggcctgcggctgctcgtcatcgacacccgggtccggcacgcactggccgacggggcctacgcccagcgccgaacctcctgccaccgggcggccgaggccctgggtgtggccgccctgcgcgacctcccccaccaggggctggagcagaccctggcccgcctggaggacccggtcgtacgcaagcgggtccggcacgtggtgaccgagaacgaacgggtcctgcgcgtcgagcaactcctgcgcgcgggtcggctgcgcgaggcgggcccgctgctcacggaaggccatgcctcgctgcgcgacgactacgaggtgtcctgcccggagctggacctggccgtctcgacggccgacgcggccggcgcgtacggctcccgcatgacgggcggcggcttcggcggctcggccctgtccctgatcgacgcggacgcggagcggtcggtgacccgggcggtgacggacgccttccgccgcgccggcttcgccccgccccgcatcacgacggcatccccgtcgcccggcgcggcccgcctggtctaggtgtattgacccgtagcgttgttcacacggctgatgggtggcttgccgttgagtgcggtgtggcagcggtggtggttgtaggtgtggaggaagtctgccagggctgctgtccgctcgtcgttcgatcggtagggccgcaggtaggcccattcgtcgaggagggtgcggttgaagcgttcgaccttgccgttggtctgcggccggtaggggcggatcttcttgtgggtgatgccggccgcggtcagggccctggtgaactgtttggctttgtagcaggatccgttgtcggtcaggacacgttcgacggtgatgccgtggtcggtgaagaacgcgtttgcccgctgccagaaggcgatcgcggtgtgctggcgctcgtcgggcaggacttcgctgtaggccaggcgggagtggtcgtcgacggcggagtggatgaagctgtagccgatcaccggggtggagttcttgcgctcggtggtggtggcctggcggtttcggtcgcctgctgtgcggcccaccgtgcgccagccgccgccgtcggggatgttgccgagcttcttgatgtcgacgtggaccagctcgcccggccgggcgcgttcgtagcgccggatggcctgcccggtggggcggtcgagccaggccagacggttcagaccgtggcggaccaggattcggtgcaccgtcgaggcgggcaggcccaggatcgggccgatgcgggccgggccgagcttccggccggtccgcagacggcagacctgggcctcaacggtggccggtgtgcggtgcggagtcgcgtggggcttgctggagcggtcgtgcaggccggcgtcgccttcggtccgccagcggcggacccacttgtgggcggtggcccgggatatacccatctcggccgcgacgtgtgcgacaggacggcccgagcggacccgttcgaccagcaggcgcctaccgaagacggtcagccgggcattacggtgggacacgaagacctccgtgcggtgagttcctagacagctcccaccacaccggaggtcttcgccatgttcaagacctgaccagtgtcaacaacgctcgtgatcaatacatctaggccgtctgcgtcggcggggcggcccggaggtgaggggccgcctcggcggcggtatgggcggaggcgaaggtgaacgcgcggggggacggcccgtgcgcccgcagatccgccagacgctccagagcctcttccacggtcggcaggtgcccggcggggatccaccagagcaccatgtgcgcctcgacgtgccgctcgaaccattcgcggcgccgtcgcatcacttccaggtgcccgctgcggtaggcgaagtcccacagagactcctgggtctgccacaccgacagattgacgacgacgtcggctcccgccgggcgcaggccggtggcgtcggccgccccctcctccacgaggcgccacacgaagccgggcgcgctgtcggcggcggcgttgaccggatcgagcatctcgacgaacggcgccatgcgcgggtcgtcgaaggggtggaggagcgtggcgacgttgagctgggcgaggtgggtggcacgcgtggatgcggtcatggcgtcatcccagcacgcccctccatctatgtcaacgatcattgtttttagaagcctcgaccaccacgcaacactccccgggccgggcgtccatccgggcgcgcacgggaccgtccacgccgagcagcccctccagcagcgcgagattcatgccgcagacgagcggcgggaagcgttcggcgacggcatggaaggggcagttgcgcatacggacgacagccgcggccgctccgggcgtcgccgcggcgccctcggcgtcccggacaccctccgcgccctccgtgccctcaccgccctcgccgccgtccaggtacggttcgtaaccgcggccggccagcatctccacggcctcttccaggccgccacagggcgcagccgagccccgcagtgcctcgccgcggcggcccgcggccgcgtacagccccgcgtccagtcccgcctgctcggcggcctcggcgagcaactcggcggcggtgaggtagtcgcgggcgggcagcgacaccgaccgctcggcccgcgcccgcgtgtacaccttggccgggcggccggcgcccggacccgagcggcccgtcaggcggcggctgccgctctccagcagcccggcctcggccagccggtccagatggtgcgcggcgagggtgcgcgcgaccccggccgcctcggcggcctcgttgcggccgacctcgcggccctgtgccgccacgtactcgtacaggcggcgccgcaccggatcctgcaacatcgcgatcgcgtcgatatcgttcacgcgacccattctaggaacaacgcagattggaaatagaagcgcgaagcccacccccgccggtgacgtcaggaccgaggccgatcccggatcacgtcatgctgccggacaccctctaggaggacgggggcggcggcgtggcgccgggcaccggggcgacgaacctcgggttgtcctgccgggcggcttccatgggctggacgtcgaccgcggtcacgccggtaccgggcagctgctcgccgaccggttcgccgcggtgctggagggcgaaccgaacggcgaggggctcggcccggacggcgtcgttgacgtagacgtccttcaccgccgggaacggcgacgaccccaccacctaccgcgtcaccctgcggtggacgtacgaggcgactacccccacctgcgcagatggttacgcgaacgcggcatcaagcaccgcatagcccgcaaaggaatcgaaccgtcgaaccggctcggccgacaccgacgggtcgtggaacggaccgtgtcctggctcgcgggctgccgccgcttacaccgccgctacgaacgcaaggccgagtactttctcgcgttcgcaggcatcgccgcagccctcatctgctaccgcagactcaccggatgagatggcttctaagaggtctttttatcccagaatctggagatttgatgcgattcttgaagtggtcgaccacggtgcggtagtgaccattgacggagtcggtttctgtggggtgtgtggggtggcttgtggggcgggctggttcttgcgcctgtctcatcccaggatgtccgtcgattggcggcccgtgtgcttccagcgtcgcggccgtgcgcctgggcgcattcggtccgcggcggtacgccggactcatgacaacacgacgtccgtatccgagtgatctgtccgacgcacgctgggagttgatcgagccggtccttgcggcctggcgcttcgagcgccgtggccgggctctggactttggccggcctccgaggcatgacctgcgcgagatcatgaacgcgatcctctacgtggaccgcaccggctgccagtgggcctacctcccgcacgacttcccaccgcaccagagcgtctacggctacttcgccagatgggctgacgagggcgtatttgcccagctcaatggcctgctcaggcagcttttacgggagaaggaagggcggaatgcagagccaactgcgtgtgtgatcgacgcgcagagcgtcaagacatccaccagcgttcccgccaccagccagggcatcgacgcgggcaagaagatcgcgggccgcaaacgcagcatcgtcaccgacaccctcggcctcctcctcgccgtgctggtcaccgcggccagcgtgcaggactccgcggccggcacccgcctcatcgaccagaccgccgcagaccacccgtcaatccgcaaagtgtgggtcgacggcggataccgtcagcacctggtcgagcatgccgccgctctgggcatcgacatggagatcaccgcacgcaagcccgggaccaagggtttcacccccatacccaagcggtgggcagtcgagcggacctacggctggctcatgctccaccgccgcctggcccgcgactacgaaaccctgcccacccgctccgaagccgtcatccacatcgcgatgaccgacctcatggcccgccgcctcaccggcgagaacaccgtctcctggcgcgacccgaagaagaccacagaacacccaattccgggatgaaacagagggataaaacgacctctaaggaggttgggttgggagccggaagtgaagtggacgtgctgctcgccgccgatctggaaggcggcagggtcgttgaacgtgttgccggactcttcggcggggccggcgtccgcggggccgggctgtgggcgggcctgggccaggagttcgctgagctccgccaccgactggtcgcgctctaccccgtccaggtcctccagcagggatttgatccggctctgccagacggcctcctgccgcgcccggagccgctccacctcgtcctggccggccgtcgtcagttgtcgcctcggtagtcccctgagccggtccccgccccgtctcccggccctttccgccgcgttgggtcgtcctacttgctttgtgggctcaccccggcctaatatcgtcatcgtgacgataaccgcccagtggccccctccctgcaggcattgactccaggggcttcgagtccctccatggacccgaagcacacaagtacgtggcccgcggtcccgccgtccacctcaatgcgctgcccgcggccgttccgggcggtggagcccacgaccacgctgggatcgacgacggccagcacggagaagtgatcatgttcgaaatgccggtaaatccctttgagctctccgaagaagcgctgagccgaatatctgccgatgactcatggaccccgatcgagtcggagatcccaaaggccaacgccaaggtgattcgccatttcctcactccggccgaagtggaggcattcacgaccgaactggccgcccagcgctttgccccggtgggccgagacggcgttgccgccaactatgcagagggagatccggtcgctcatctccgcgccacggccgaatctacagtcctggcggctgaattctaccgcaggctgcggacgcttctatcgcttgaagtgggatcgggcgatccgacggattcggacggaaggccttggaggccgacggccgtcaatccgcgtatgcgcttcatcacgtacgaacacggcggattcattgtcccgcactacgattcgccctatttcgcccccgacggaaggcgcactctcctgacggtcgtcgtctacctgtcgtatgaggccgtgggcggagaaacgcggttcatcgccgataagcagaacgatcttccctttgcgcaacgtgatttctctgactggccgcggctcgcgaagcctgaggaaatattgagtgcccaccaccccgaaccgggcgatgcgctcctcttctggcatcggacacttcacgactcggccccgcttcttgagggtacgaaaacaatactcagaaccgacgtgctctacgagcccgtagatgtgccttgaccagcggcaaggccaccgtcgcgttgtccctcaccccggagaccgacgtccggcacgccgtgatcgcccacctccgggccgggcggcatcgggccctgcccgcggccgggcatcgaatcccactcgcaccggacggcagggagagcagcatgaccaacgggaagatccgcaccgactgggtggagacggtgtctcaggacggcctgcacctgatgcagacgcgcttggaggtgagagttcctacgtctgagggtcgcaagttcatcacctgcggtctggcccggaagacgtacgtggtgaaggacggtattgcctgtcgggtttcgtcctacgcactcggccgcgacctgggcagcccgggcaactacgacgtcgagatcgtttccgcgacggggggccctccgatccggaggttcttcaaccgtgacggcgtgccggccgagatacgcgagggcgctctgttcgacgcgcatgaggggcttgacgatggcgagtacatcgtccggatcgcggcgggaatgacgaccagctgggacagcgggacgggacagagcatcgagctccctgttccgcgccatgagctcgcattcgtcgtggtgggatccgcaccgcaggaggtgcgcgcgagtaccggcggcccgtgggcggcgcggccctccgtggagatccccgtggtcgattggcgcgatcagcccacggcggaggcggcatggaaggcctacctgaacgggaacagaatcagtctagatgcctacgggatcttctccccaaagcatctgatgaggaatcaacgggataccgctctggagattctccggagcgagggctactccataccgcgaaccccggaacccgccgagacgccggggacctggctgggccactggggtggagcatggatgccggccgatgtgctcgcggcccttcacaccgtgccggacgacaccgcgcaacgtgcgtggtatcagggagcgaaggaatccctggacatcgcatgggatatgcacgtcctgtggaccaccgacgtgttctgaccgggcccgcgctccgtccgtgaccaccgtggcgagccatcggcagtcaccctgcaccttgtggtgctgccgagtaccggtcgcggccgggtaccgcggactcgccaaatgagatgacctctaagaggtctttttatcccagaatctggagatttgatgcgattcttgaagtggtcgaccacggtgcggtagtgaccattgacggagtcggtttctgtggggtgtgtggggtggcttgtggggcgggctggttcttgcgcctgtctcatcccaggatgtccgtcgattggcggcccgtgtgcttccagcgtcgcggccgtgcgcctgggcgcattcggtccgcggcggtacgccggactcatgacaacacgacgtccgtatccgagtgatctgtccgacgcacgctgggagttgatcgagccggtccttgcggcctggcgcttcgagcgccgtggccgggctctggactttggccggcctccgaggcatgacctgcgcgagatcatgaacgcgatcctctacgtggaccgcaccggctgccagtgggcctacctcccgcacgacttcccaccgcaccagagcgtctacggctacttcgccagatgggctgacgagggcgtatttgcccagctcaatggcctgctcaggcagcttttacgggagaaggaagggcggaatgcagagccaactgcgtgtgtgatcgacgcgcagagcgtcaagacatccaccagcgttcccgccaccagccagggcatcgacgcgggcaagaagatcgcgggccgcaaacgcagcatcgtcaccgacaccctcggcctcctcctcgccgtgctggtcaccgcggccagcgtgcaggactccgcggccggcacccgcctcatcgaccagaccgccgcagaccacccgtcaatccgcaaagtgtgggtcgacggcggataccgtcagcacctggtcgagcatgccgccgctctgggcatcgacatggagatcaccgcacgcaagcccgggaccaagggtttcacccccatacccaagcggtgggcagtcgagcggacctacggctggctcatgctccaccgccgcctggcccgcgactacgaaaccctgcccacccgctccgaagccgtcatccacatcgcgatgaccgacctcatggcccgccgcctcaccggcgagaacaccgtctcctggcgcgacccgaagaagaccacagaacacccaattccgggatgaaacagagggataaaacgacctctaaggcgaggacggcagcggcgggtatcagtctgcggttcacggttttcacggttgcccttcgggtcgcggtgcccccgcaccgggcggggcgggggccggggagtccggtcagaacgcgggcgcgacagcgccggaggcgtcatgatccatccggtcaaactacccggcggggtcgaggcggccggtggggtcgcaggcccgcgcgtgttgcacgttgttcacaccccgacgcccggtttccgcgccggcgcccggggcggacacctagactgaacgatcggttgatcatgtaatcgtcgagtcggaggaatgaaccgaatgcgctatctccccctgggcagttccggactgcaggtctccgccgtcgggctcggctgcaacaacttcggtggccgactggacgcccaggccacccgcgccgtcgtcgacgccgccctggacgcgggcatcaccctcctggacaccgccgacatctacggcggcgccggcggctccgaggtacacctcgggcaggccctcaagggccgtcgcgaccaggtcgtcctcgccaccaagttcggttacgacggcgtggacatgaagtacgggcccgccgccggctcccgcggcggccgcgcctacatccggcgggccgtcgaggagtccctgcgccgcctcgacaccgaccacatcgacctcttccagctgcacagccccgacccggccaccccgatcgccgagaccctggccgcgctcaccgagctcgtcgccgagggcaaggtccgttacatcggccactccaacctctccggctggcagctcgccgaagccgcccacatcgcccgcgagacgggctcggtccccttcgtgtcggcgcagaacgagtggtcgctgctgcagcggtcggtcgagcgcgagctggtcccggcggccctccactacggcgtcggcgtgctcccgtacttcccgctcgccaacggcctgctgaccggcaagatccgccggggtgcgcccgtaccggccggatcccgcctcgaaggacgcgacgcgtacctcaccgaggagcgcctcgacgtcgtcgaggcactggccgtgctcgccgagaagcacgaccggaccgtcctcgaactcgccatcggctggctctccgcccagcccggctgcgcctccgtcatcgccggagccacctcccccgagcaggtacgcgccaacgcggccgtcgccgaccgcccgctggacgccgaactgctggccgcgatcgacgcgatcccgggggcgctcaagccctagcgcgtgtccgctcagacgggcgcccccgtcaggacgtccacctggccggtgtccagcgagtagtaggcgccgacgacggccagggcgcccttcttcacgaggggcgctaggtcggagttggcgcgcagaccgtccgcggtgacccggatctgctggtggatcatggtgtcgaccgggtcggcacccgggttctcgaccgtcagcaggtacgccggtcccagcgccttcacgatcgcctgcaggttcccgggcaggggcgtgccgtcctgcagcgacttgtacgcggcttcgatggcgccgcagcgctggtgcccgagcacgacgatcagcggggtgccgcccgtcatgggcccgtactcgacggacccggtgaccaccgggccgaccgcctgcccgcccgtgcgcaggacgtacagatcgccgagcccggtgtcgaagacgagctcgggcgccacccgggagtcgatgcaggtgaggaccaccccgaacgggtcctgcgcctcggcgacgagctgccgccgctcgggatcccggtcggggtggtcgagatccccgctcacccagcgcgcgttgccctccatcagacgggcgaaggcggccttcggcgtgtccggccgcggctcgggcgcggcggtcgtcgccctcggcgcgcgcggcgaggagcatcccgcgagtgcgaaggccccggcggcggccacgaggccgcgggtcagcacggccctgcgggccggagatcctgctgtgtgcatgggcggtacccctcggtcgtgatgaccgcgattgttcatcgttccgggggcgggcggaccgcagccacacgcgggcgcgggcgcattgccacggacggcccacggcccacgggcccgggggacatcgtgtcctgggtccgcgggccgcgggccgcgcgctctggggctgtgggccgcccgtgcgggctcaggacacgatgtccttgcgggagaagccgcggaaggcgagcgcgaacagcaccagcgcgtacgacaccgacaccaccgcccccttgaccatcccgccccactccagctgcggctgcagggcgtccgcccacgcgaactgccagtgcgccggcaggaactcccgccacgagccgagcgccgtcaccgcgtccagcacattgccgacgatcgtcagcccgaccgccccgccgaccgcgcccagcggcgcgtccgtccgtgtcgacagccagaacgccagacccgccgtcacgagctgcgaaacgaagacgaaggccaccgccagagccagccgcggcaccgtgtccccggccgccagcgccccgcccgccgggagcttcaacggcccccacccgtacgcggccgtgcccaccgccagggccaccaccggcagcagcaccatcgccgccaggctgaacccgagcgccaccaccagcttgctccacagcagccgcgcccgcggcaccggcgaggccagcaggtagcgcagcgaggaccagctcgcctccgaggccacggtgtccccgcagaacagggccaccggcaccacgagcaggaagccggccgagacgaagagacaggtcgcggcgaagttcgcacccgaggccgtggccgtgtcgatcagggtgatccggccgttgccgccgccccggctgcccggcccgccgcccaccgcgaacgcgatcatcaggatgaagggcagcgccgccagcaccccgcccatcaccagcgtccgccgtcggcgccactgccgcagcgcctccacgcgcagcggcagcgtatggctcgcccggtagcccggagccgtttccggagccgcctcccgcgccgtcgtcaccgtactcacgccgcacctccgatcagggtgaggaacgcgtcctccagtcgccggtgcggtcccactccgctcaccggcacctccagccgtacgagttcggcgatcagccccgcggccgtcgcgccttcgagccgtacgagcagcccgtcatcggcggccaccacggaacccactccctccagcgccgccaccttctcgacgctcacctcgtccaccggctccgccagggtcaccagcagggtgtccccgccaccggtgatctccgcgacctcgcccgccgcgacccgctgcccgcggtccatgaccaccaggtgcgtacaggactgctccacctccgacagcaggtggctggagacgatgaccgtccgcccgcccgcggcgtagcggatcatcacgtcccgcatctcgcggatctgcggcgggtccagaccgttcgtcggctcgtcgaggatcagcaggtccggcatcccgagcatggcctgcgcgatcgcgagccgctggcgcatgccctgcgagtacgtgcgtaccgcgcgttccagcgcgtcgccgagtccggcgatctccagggcctccgccatgtgcgagtcctcggccgggcggccggtggcctgccagtacagctccagattggcgcggcccgtcaggtgcgggaggaatccggcgccctccacgaaggcgccgacccgggacagcacgggcgccccggcccgtaccgcgtgcccgaacacccggatctccccggcgtccggcgagatcagccccatcagcatccgcagggtggtggtcttgccggcgccgttgggcccgagcagtcccagcacctgccccttctcgacgcggaaggacaggtcccgcaccgcgtaccggtcctgcgccttcgcgtaccgcttcgtcagtcccgtgatctccaggggtacgtcggccagtgcggcctccggccgcggcgcgcccgaccgcgggcccgcggctccggaagccccccggccggtccgccggatcccgagcagcgccgcggccagggccgcggcgcccagcggcagccaccagatccaggcgggcatcccggccgcggcggtccgtacctccgcggcgacgggcacggccagggggccctccacggcgacggtgtaggtggcgggcgcggccgggctcgcgtagccgaggtcggtcgcggcgaccaccagccgaagccggtgtccggccggggctgagtggtcgatcgcgggcagccgcagccgcacgctcgtaccctgctgggcgttctccacccgcaccggggcgaccagctggctcggcagcacctgctgccggccgtcgggccccacgtcgtacaccttgccgaagaggacggccgagccgtccgcggccgtcgacctcaccttcagggtgagggtcggggtgccggtgatccgtacgtcctctgtcagcggcgccgagtcgaaccgggcgttctggccggggaagtccagcgagagcccggccccgaaggcggcgagctgcccaccgatgcccggcagcgaggacagcgcgggaggtgcgccgcccgccggattggcgaacgtctgctccggccccgtcagggtgaactcccgcgggccggattccagcccggggtaccggtcgccggtcgcgccgcgcagggtgacctcgccgtcggtggagtcgatgcctccggagcgggtgacgcggaacgccgggccggtgccggcgccctcgtcccccttgaggtggcggtcgaaccaggaggccacccgggcctcgacccggtcggtctcgcgcatcccgccgtcgtgtccgccggccgcccagtcgacggagacgggcgcgccgttcgccgcgatggccttggccatggcatcggcctggtccagcgggaagagggagtcgtcctggccctggacgatcagggtcggcaccttgatccggtcgccgacggccgacggactgcgctgttccagcagggcgcgggcctcgggatcgggcttgcccgccaccgcgacgcgttcgtacatggcgcagagctcgggctggaaccgtccacagccgggcgcggccgaggcgtccggccgctgccggggcggggcctgctgcatcccgtcggtcgagccgctggtgaagaagatgccggaccagagcttcttgaagactccgttcgggaagagggagtccgcgaggttccagtaggtgatctgcggggcgatcgcgtccacccgcgggtcgtgaccggccgcgagcagcgagatcgcgccgccgtaggaggccccggagacgccgacgcgcggatcgccgggcgcgtcgagccggacctcgggccgggccgcgagccagtcgatgagccgggagacgtccttgacctcgtactcggggtcgttgaggccgatccggccctcggagcggccgaagccgcgcgccgaccaggtcaggacggcgtacccgtcgcgggcgaggtgctcggcctgctcgcggacatcgtccttgctgccgccgaaaccgtgcccgaggagtacggcgggacgtttttgcgcaccgtcgcccgccgtgaagtaggaggtgtcgatccgggcgccgggcatggacaggacctggtccccccggtgcaccgcgggcgtgtcgccggccgcggacgcggccgtccacgtaccggcacccgccacgacggcgagcgcggcggcgccggccagcaggcggtcgcgacggcgccggaacattcgcagcttcatacgggaaccctaaagggccaccgctcgggcaccgagcacccgcagggggagccgtcccccttctcagggaccacgccgggcccccgggcgtaccgcacctgcggtacgcccgggggccgcacggcctagatgtattgacccgtagcgttgttcacacggctgatgggtggcttgccgttgagtgcggtgtggcagcggtggtggttgtaggtgtggaggaagtctgccagggctgctgtccgctcgtcgttcgatcggtagggccgcaggtaggcccattcgtcgaggagggtgcggttgaagcgttcgaccttgccgttggtctgcggccggtaggggcggatcttcttgtgggtgatgccggccgcggtcagggccctggtgaactgtttggacttgtagcaggatccgttgtcggtcaggacacgttcgacggtgatgccgtggtcggtgaagaacgcgtttgcccgctgccagaaggcgatcgcggtgtgctggcgctcgtcgggcaggacttcgctgtaggccaggcgggagtggtcgtcgacggcggagtggatgaagctgtagccgatcaccggggtggagttcttgcgctcggtggtggtggcctggcggtttcggtcgcctgctgtgcggcccacggtgcgccagccgccgccgtcggggatgttgccgagcttcttgatgtcgacgtggaccagctcgcccggccgggcgcgttcgtagcgccggatggcctgcccggtggggcggtcgagccaggccagacggttcagaccgtggcggaccaggattcggtgcaccgtcgaggcgggcaggcccaggatcgggccgatgcgggccggaccgagcttccggccggtccgcagacggcagacctgggcctcaacggtggccggtgtgcggtgcggagtcgcgtggggcttgctggagcggtcgtgcaggccggcgtcgccttcggtccgccagcggcggacccacttgtgggcggtggcccgggatatgcccatctcggccgcgacgtgtgcgacaggacggcccgagcggacccgttcgaccagcaggcgcctaccgaagacggtcagccgggcattacggtgggacacgaagacctccgtgcggtgagttcctagacagctcccaccacaccggaggtcttcgccatgttcaagacctgaccagtgtcaacaacgctcgtgatcaatacacctagacgttcggcacgtggtcgggattgtccttctccgccttgaccgggtccggcttcggggccggagcgggcatcggtgccgggttcggctggtgctcgcagtagaccttgccctggtagaacttgcatcccggcatgttgtcgacgtcccggaccttgccgttgcggtcgtgccggttcttcctgtcgtggtggcccttgcgctcaccacggtgatcctcccggcccttgtcctgatgaccgccgttctcgtatccggcccggtggacggtggccgagaccgtctccggggcgtgcggagcggcgaaggccgtcccaggcagcagtatgcctccggcgacgaacgcgcccgacacggcgaccatcgcgaaacgctgcttgcgggaggtgcggatcatgagagtgctccagggggtgggggtggggtgaaaggggcgatgagtcgttatgtcgcttttgcccctacacacgagactggcggccgatcctcacgagagcgtccgccgactgtcacgggcgcgtgacagcgccacacgcccgacccacctgcgcggacccacctgcgtggaccgacctgcgccagggggccggtggcgtcaggatggccgcatgctgctggccgaagtcgcacgcgtgtccaaggaggtcgccgagacctccgcccggtcccgtaagaccgccctgctcgccgggctcttcgccgacgcgcccccggaggaggccggcctggtcatctcctacctctccgggcgccttccgcagggccgccccggcatcggctggcgcaccctcggccaggaggccgaaccggcggacgcaccgacgctgaccgtcctcgacgtcgacacggcggtgggcgaactggccgccacccggggcgccgggtcggtggagcggcgcggccgcgtcctcgccggcctgctgggccgggccaccgcggccgagcaggtgttcctgcgcagcctgctctccggcgaggtacgccagggcgcgctggacgcggtggccctggagggcgtggccgcggccgccggcgtaccggccgcccatctgcgccgggcggtgatgctggacggctcgctgccccgggtggcggcggccgtgctggccgagggcgcgcaggcgctgcgcacggtcacgctgcgcgtcggccggcccgtccagccgatgctggcgggcacggcgaagtcggtcgccgaggcgctgggcgcgctcggaccgtgcgcggtggaggagaagctggacggcatccgcgtccaggtccaccgggacggggccgacgtacgggtgtacacgcgctccctcgacgagatcaccgagcggctcccggaggtggcggagctggcccggtcgctgcccggggagcggttcatcctcgacggggaggtcatcgggcgggcgccggacggccggccggtccccttccaggagatcgcgagccgcgtcggctcccgggtcgacgtcggggcggcccgccgcaccctcccggtcgtcccctgcttcttcgacgtcctggccgtcggcgaggacgtcctcctcgacctgccggtgcgcgagcggtacgcggccctcgccgcgctcgtacccgaggacgcgcgggtccgccgcctcgccgtcgaggacccgggggagcaggaggccgaggccgaggagttctgggccgagaccctgcgccgcgggcacgagggggtcgtggtcaaggggctggactcggcctacgcggccggtcggcgcggcaggcactggctcaaggtgaagccggtgcacaccctggacctggtggtcctcgccgccgaatggggccacgggcggcgcaccggtctgctgtcgaacctgcacctgggggcgcgcaccgccgaggggacgtacgccatgctcggcaagaccttcaaggggctcaccgaccagatgctgcgctggcagaccgaggccctgcgcgcgctcgccacctcggacgacggcttcaccgtgcgggtgcggcccgagctggtggtggagatcgcctacgacggcctgcagcgctcctcgcgctacccggcgggggtggccctgcgcttcgcccgggtcctgcgccaccgcccggacaagacggcggccgaggcggacaccgtggccacggtcctggcggcacacgcggcctaaggccgtgtccgcaaagtcccgcctgccccgcgacgcctggcaccgcacctcgctgcgttgtcgggcacgtccgagtacgtccagtacacggacggccctccgccttgcgatgcacggcgccagacgccgcgtggcccgcccttcgggcggccggcgctcctgtgcggacacggccttaggagtgccgggcggatcatggcccgcgctgcgccctgatccgccggacgcggcctacgcgtcgtcggggtcgctgtcgtcctcgcgcagcatccgccagagccgggtgcggtggagcacgtagagagccgcgagcaggaagagcacctgcaggcccacggcgagcagccagaagacggcacggctctccagctcgtccgtcaggtaggcgaagttcatgccgaagaacccggtcaggaaggtcagcggcaggaagatcgtcgacaccaccgccaggcggttgatcacgccgttctggtcgcccgacaccagggaggagtagctgccgaaggcccgccgggcggtgtcctggagggactcgatgtccgcgagcaccagattcgcggtgcgccggtactcgtggacgagctgccggcgctcctgctggaagccgcggttcatcacccggcgcgtgacggtctcctccgccacccggtggtaggggaggagggtgtggtgcaggagggccgcggtacgccgcagccgtgacagccggtagagctgctcgggctcgcgccggcggaacatggcgtcctccaggtcctccacctccagcagggcccggacggcggcccgtcggtaggtctccatggcctcgtccagcagcaggaacagcatggcgacggagtccgccgggctctccagggggaagcgggcggtgacgtccccgatcaggggggccggcccccggtgcaccgtgaggaggtaccgatcggtcaccacggcgtggacgtggatgacccggtcggcgtcgaccgcgggcacgacgaacgcgccgctgtccccgaagatgtccgcccgcgcggactcctccttgcggccgagccacgccacctgctcggcctccaggccgagcaggtgggccagcgggggttcgccggaagcgctctccgcgggcagttccacgtccacgaacaggaagcgggacgtggccagacgctcgcgtgcctccgacacctggccacgggccagggtgccctccggcatggacatcatcgaaacgatcatcgtccctcgccgtgggtcggccggtgcggtgcttcccagcctgtagcgagcgggatcccgcgcaagcgcggtgacgcattcgcccggcaagccgccccgaacaggtgagaggagacgtccccacggttttgcctcagaggtaaggcggtttgccaggaaggcaagattctggctcaatcggggacatgaaccccggtactgcccccggtcccggccccggtcccgaagccgcggccgacgagctgcccgccgtggcaccacagcttcgcgaactgcgccgccgtgccggactcaccctggaggccgccgccgcgcgggcccggctctcgcccgctcacctgtcccgcctggagaccggccgccgccagccctcgctgccgctgctgctcggactcgcccgcacctacggtacgaccgtctccgagctgctcggcgagacccccgccgtcgcggatcccatcgtacgggccggcggtccgggcgcccgcgaggccgacggctggacgtactggcaggcaggcggctccgggcgggggatgcaggcgctgcgcgtgcacgtgccgcatggccgcagccagggcgagctggtccgcgtacatcccggcgaggagtggctccacgtcctggagggtcggctgcggctgcgcctgggcgaggccgagtacctgctggagccgggggacagcgcgcacttcgactcgctcaccccgcaccggatcggcgcggcctccgcgggcggggccgacctgctcttcgtccacaccctgctgcagagcagcctggccgggctctgcctcggcggcgccgccacgaccgggcccgcgcccgcaaggccggcgcccgcgtccacacccacgaccatgcccacgcaccaccagtaagcggaggagccgtacccatgtcccaagccgagaagcccgccaccgcgaccacgccggtgcccgcgcccacgtccatacgggcccgcttcgagtccaagttcccgcgcggcctgatcatccggctgatcgcctacctgttcgtcggccacctcttcgccttcttcgtctacctcctcttcgtcctgggcggccagaaccagtaacccccgggggcggacgagttcaggccgcgcgactctggcaacgtcaaggacctgtggctaccctccgcgcatgatttccacggttgtctggggtaccggcaacgtgggccgtctggcgatccgtgccgtcgaggcccatcccgcgctccaactctgcgcagtcatcgtccacgatccagccaaggtcggccgcgacgccggtgaactcgggcaactcgaccgcccgtcgggggtcgaggccaccgacgacatcgaagccgtactcgccgcccgcccccaggccgtggtgtacgccgcgtccggagacatccggcccgacgaggcgctcgccgacatcacacgggccgtccggtcgggcgcggtcgtcgtgagccccgccctgtacccgctctacgatcaccgcagcgccccgcccgagttccgcgacccggtgctcgccgccgtcgcggagggcgggggctcgctcttcgcctccggcgtcgaccccgggtggggcaacgacgtactcccgctcctgctcagcggactcggcaccaccatcgacgccatccgctgccaggagatcttcgactactccacctacgaccagccggactccgtccgccatctcgtcggcatgggccatcccatggactacgagccgatgatgctcatgccctccatccccaccatggtgtggggcgggcagatccggatgatggcccgggcgctcggggtcgaactcgacgagatacgcgagacctcggaccgccgcgcgctcgacaccacggtgaccaccaggaccatgggcgcgttcgaggccggcacccagggcgccatccgcttcgaggtgcagggaatcgtcgagggcgaaccccgcatcgtcatcgagcacgtcacccgcatccacgcctcgtgcgcaccggactggcccgtgccgcccgacggcggcgacggcgcccaccgggtcgtcatcgagggccgcccgcgcatcgaggtcaccatcgaggccacggacgagggcgagaaccgctcggcgggcggcaacgccaccgccgtcggccgcctcgtcggcgccatcgactggctcgtcgaggcggaacccggactctacgacgccctcgacatcccgctgcgccccgccatcggcagactcggaaggaagcagtcatgaggatcgacatccctgaaggccagcaccccatcgagtacgtgtggggcgacatggtccccggcatcggcatggccgccgcgaacttctccctgtcggtgtacgcccacaccaccctgggcctgcgcgagttcgaggcggcccggctgcgcgtcgcacagatcaacgggtgcgtcttctgcctcgactggcgcaccgagcgggagggggagaaggtcgaggaggagttctccgacgcggtcaccgagtggcgtacgaccggcgcgttcgacgagcgcacccggctggcggcggagtacgcggagcggtacaccctcgaccaccacgggctcgacgaggagttctgggaccggatgaccacgcactacagccagctggagatcgtggagctgacgatgagcatcgggtcctggctggctttcggccggctcaaccacgtgctcggcctggacagcgtctgtgtcctgccggggcactgagcggcggcgcaccgcgcgcggagcgcggcgggaaggcaaaaggggccgttcggtggatccgaacggccccggccgctggggggagggcgcggccctacgggaggtcggttgcgatgatcttctcgatgttgcgttcggcgagtgccgtgatggtgacgaagggattcacgctcgtgttgccggggatgagcgcgccgtcgatcacgtacaggccggtgtaaccgtgcaggcgaccgtagttgtcggtcgccctgttcaggaccgcgccgccgagcgggtggtaggtgagggtgtcgttccagatcttgttgccgccgaacaggtcggtccggtagatcgtcccctccttcgaattgatcttgtcgaagatcgtcttggccatcgagacggacggctgcttccaggccgtctgccagctcaggtcggccctgccggtcgccgcgttccaggtgaactcggcacggttcgggttcttggtgatcgacaggtagaacgaggcgtacgtctcgatcccggtggggagcggcgccacttcggcgaaggcgcccccggcgtcccagttgtcgatgccggagcaggggatggtcgactggagtttgccggtcgggtcccacaggtggttcgcgcggccgcacatgacgttgccgttctcgccccagcccttgccgacctcgccgttgaggttcggcagtgccccggtggccttcagcttgaccaggagcttgctggtgccgacgctgccggccgcgaagaacacccggtccgccgtcacggtcttggtggccaccgtgtcgccggtggtgttgagctggtcgatggtgaccgtgtagccgcccgccgtggcgggggagaccgaggtgaccttgtgcagcggcgagatggcgacccggcccgtggccttcgcctgggcgaggtacgtctgcaccagcgacttcttgccgtggttgttgccgtagaggatctccccggccagggcggacttggtggcggtgccggcggcctccttcttcatgtagtcccagtcgtacacgtcgggtacgaaggtccaggcgaagccggagcgctgggcgtgcttgcggccgacgcgggagaactggtagcagtcggcggtgtcgaaccaggcagggtcgatcatgccgaccccgagccccgcgttggccctcgggtagtaggtgccgtacatctcgtcggcgtccaccgaggggaggacggcggcgaagttcgcgcgcttgggcgtgaccgccatgccgccgttgaccagcgaaccgccgccgacgccgcggccctggtagacggtgatgccggcgaagtcctcggcgtccaggatcccggtgtacttggggacgtccttgtcgatcgggaagcccaggaagttgctgagcggcgccttggtccgggtgcgcagccagaaggaccggtagtccgggctggtcaccgtggggaagatcttgccgtccgagcccggcgtgtcccaggacatgcccatttcgatcatctgcacgtccacgccggcctgtgccagccgcagggccgccaccgatccgccgtagccggtaccgatgaccagggccgctacgcgggcgccgtcggagaccgggccgggcggggcggccgcctgcgccggggtgaggtgacccgccagggccatggccccgataacagaacctgttctaccgaggaatccgcgccgggagatcccgttggaggtgtttctggacagcggtttatcgctcatgtgacgttcctcactcgctgacagaatgggaacgagttctactgccgcccgcgtgtgaagtcactacatacgtctaggtaacttccggtcgatcacgtgacgggggaagcggcatccgggcgccggacccagcccaggaccagcagcgacgcgaccgccgcgaaggcgcaccaggtggaggcgaattccagccgccacagcgctgagcaggccagcgcccccgccgccagcaccgcgccgagggttctcaggcgcttgtcgccgccgagcagcaaggcgcccagagtcgcgaagagatagcccgccagcacgagcggcgtccacggaacattcacgccgtacccgatgccgcggccccggatctcggcggtcaccgaccgggtcgcgaggcagtacgagagcactccggcggtggccggccccgcggccaccggcccccacaggcggcgccggaccccgggcgcggcgcagcaggaccccggccggcacccagaccgcgagcagcggcagcgcggcgacgggcaggtcacgggcccgccgcagccgcgccaggcacacgatgccggcggcggagatcaccgtccccgccatcagatcggccgtcgcgctccagcacacgggatcagccggactcctcacggggttcgagcggcggggccgacaccgcgcagtacgtatgacactgggggtggcacgcctcgggcacgggggagcgtacggtcgcccaggccagggcggcaccggccacgaacgccccggtgcaccagagcatggcccgcccgaaagcggcgtcgaactgggtcgccgaacggtacgactccggccccattccggacagcagtggcagcgccgccaccgcgagcagcccggcgacgcgcgccgccgcgttgttgatgccgctggccaggcccgcccggccgggatccaccgaggcgagcaccgtcgacgtcagcggggccaccagggccacgaggcccatgcccatgacgaccatcgcgggcagcacgtcccgcacgtaggaggccgcgggtcccacccgcagcatcagcagcgtcccggccgcacacagcagcggccccaccgtgagcgggacgcgcggcccgatccgctccccgagctcacccgagcgcgccgacagcagcagcatgaggagggtcgtcggcagcatcgcggctccggcggccagcgccgagtagccggacaccacctggagctggagcacgaccaggaagaagaatccgccgatcgccgcgtacacgcacagggtgacgaggttgacggcggtgaacagacgggacgcgaagatgtccggcggcaccatggggtcgggccgccgccgctccacgtagacgaaggcgatggccagcaggaccccgagcaccgcggcgacgatcaccgcgggcgcgcccgaccgggcttcgatcagcgcgtaggtgaccagccccagggcgctcgcgccgagtgccgccccggccacgtcgaaccgcccgtgcgcctgcgggtcccgcgattccggtacgtgccgcagggcgaccggcacgcacaccgcggccagtggcacgttcagcaggaacacccaccgccagcccggcccgtccaccagccagccgccgaggaacggtcccacggccgcgcccaccccgccgagccccgaccacaggccgatcgcccggccccggtcctcggcgcggacggacgcctggatcagggccagggagccgggcgccagcagtgccccgccgatgccctgcagggcccgggcggcgatcagcaccccggcgttcggcgcgatgccgcacagcagcgagccgaccgcgaaccacaccacgccgagcacgaagatccggcgccgcccgaagcggtcgctcagtgacccgccgaccaggatcagcccggccagggtcagcaggtaggcgttcaccgtccactggagcaccgccaggtcggcgtcgaggtcctcgccgatgcgcggcagcgccacgttcaccacggtcccgtccagcatggccatggtcgacccgagcacggtggtcagcaggatccaccggccgcgtgcggacgcgatcgggacaccggctccggagggctcggcgggcgcagtcatgtcttcaggctggcccgcgcggccggtacgggccaccggggcggcccggaggacggccgaaaagccccccttgtaatgaacatgacgtctcgttcaccatgacccgcgcacgtcacgcgcacccttcccgcacatcccgcacacggcgtacgaggagacaacacgtggcccaacgcgacaaccggtcctcacgagccttacggcccacaaggtcatcgaggcccgcaaggtccttacgcacggcgctcgccgccatcacctcggtcctgctcctgccggtcggcgcgggcgtcgccgcggccgcgcaggaccccggccccggcgcacgggccacggccgagcgcaagatcgaacccaagctccgcgcccagctcgacgagtccgccaaggccgccttctgggtctacctcgacagcgccgccgacctcaccgccgcggggaagcagcagacccgcgccgccaaggccgaaacggttctgcggatcaagaaggaccacgccgcgcgcagccaggccgaagtcgtcaaggccctgcagggcgcaggggccgagtacacctcgtactggatcgtgaacgccgtgcgcgtcgtcggcagccagaagctcgccggcaccctcgcacaacgccccgaggtctcccggatcgacgccgacgacaaggtcgccctccccaagcccaccgagggcaagcgcgagaaggccgtcgccgacgccatcgagtggaacatcgaccggatcaaggccccgcaggtctgggaccagctcggcgtacgcggcgagggcatcgtcgtcgccaacatcgacagcggcgtggactacacccacccggccgtgaacaaccagtaccgcggcaagaaggcggacggcacctacgaccacgcctacaactggttcgacccggcgggcgtgtgcaccaccgcggccccgtgcgacaacaacgaccacggcacccacaccatgggcacgatggtcggcgacgacggcggcgccaacaagatcggcgtggcccccggcgccaagtggatcgcggccaagggctgcgagtcgaactcctgttccgaggcctccctcctcgcctcgggccagtggatcgtcgccccgaccgatctcaacgggcagaacccgcgccccgacctcgccccgcacatcgtcaacaactcctggggcggtagcggcggcgacacctggtaccagcagatcgtcgacacctggcgggccgccggcatcttcccggccttctccaacgggaactccggccccagctgcaacacgagcggctcgcccggcgactacgcgagctcctacagctccggcgccttcgacatcaacaacgcgatcgcgtccttctcctcgcgcggcgccgggcccggcggcatcgtcaagccgaacatcgccgcccccggcgtgaacgtccgctcctccgtccccggcggcgcctacgaggccttctccggcacctcgatggcctcaccgcacaccgcggccgccgtggccctgctgtggtccgccgcacccgccctggagggcgacgtcgcgcagaccgaggcgctcctggacggcaccgccctggacaccgacagcaaccagtgcggcggcagcgccgccgacaacaacgtcttcggtgagggccgcctcgacgtcctcgccgccgtgaacgccgccccgcgcggcgccatcggctcgctcggcggcaccgtacgctccggcgaccagcccctcgcgggcgtgaagatcaccgcccacggtccgatcgaccggacgaccaccaccgcggccgacggcagctaccgcttcgcctcgctctcggtcggcgactacgccctgaccgccgccaagttcggctacggacagcagaccggcaccgccacggtcaccgagaacgccaccgccaccggcgacttcaccctcacccaggcggcctccggcaagctcaccggcaccgtctcctcggccgcaggccccgccgcgggcgcctccgtcaccatcgcggacaccccggtcaccgcgaccgccgacgcccagggccgcttcgaggtcaccctgccgcacggcacctacgacgtgaacgccacccacgcctcccgctgcgtcaccggcggcacggcgaaggtcaccgtcgccggcgacaccaccgtcgcggtgaacctgcccgaacgcaccgacgcctacggctacgcctgcgccgccgcgggcgaccgcccgtacgccgagggcacccgccagctcgcgctcaccggcgacaacaccaccgagcgcgtcgacctgcccttcccgctgcccctgtacggcaagacgtacggccaggcctggatcggcaccaacggcacggtcagcttcggcggcaacaacaccggcgacatcaacggcgacctcccgagcacggccacgcccaacgcggccctgtacccgttctgggacgacctggtcgtcggcgccgcgggcagcggctccggcgtcttcacggccgtcaccggcaccgccccgcaccgcagctacgtgatcgaatggcgccaggtgtcccactggtcggcgcaggccgacaagttctccttctcggccacgatcggcgaggacggcaccgtctcctactcctacaaggggaccggcggcaccgggatcaagggcggctcctcggccacggtcggtgtagagaacgcggccggcaccgacgccttcgcgtactccttcaacaccgcggtcatcacggacggcctctccatcgccttccggaccaccaagagcggtgtggtggcgggccgggtgctcgacgccaacgacggcaacggcatcgcgggcgccacggtgaccgtcggcaccggcggcacggcggtctccgccaccacggccgcggacggcggctatgtcgtccagagcccgtccggctcgctccccgtctcgctggccgcaccgcagtacgagtccgccacgacgacggtgaacgtcaaggccgccgacgtcacggcggtcacccagtccctgcgcaccggaaaggtgacggcgtccaagccgtccgtggaggtcgtcctcccggcgaaccagcagcggacccggaccctggacctcaccaacccgggcctcggcacggagttcacggtgtccgaggacgcgacctggctgagcgccacaccggcgaccggcaccctcgccaccggagcgaaggtcccgctcaccctttcggtggacaccaccggactgaccccgggcgcggtcctgaccgccgacctgaagatcacgtcggcgagcggccggaccccggtgctcaccgtcccggtcaaggtcgtcgtcccgcgctaccaggtcggcctggacgcgggatccggctacaccaccacggacggcctgggcgacgcctggtccccggaccgcaagtacacccccggctcctacgggtaccagggcaacagcaccgtgcaggccaccggccgcaccatcaccggcacggacgagcagcggctgttccgcaacgcccgtgagggcatgtacgagtaccgcttcgacaacgtgccgaacggtacctacaccgtggagctcggcttcgcggagctctcctcggccaagccgaacaagcgcgtcttcgacgtcctggccgagggcacgcaggtcctgccctccctggacatctccctggaggcgggcacgtacacggccctgacccgtacgtacacggtcacggtcacggacggagtgctcaacgtccgcttcgtcacgcacagcgggttcggcaagcccctgctgaacaccctacgggtgaccgaccgcccggacaagaaccagcccggccagtaggacacgggggcggggtgcctgcgggcgccccgccccttcccgctgccgcgcgggcattcgggtggcgggagcgcggactccgcggcggcctgccgacgggccgccgcccggctcgttaacgtgggcgaccatgacccccctgtgcgaccaggccaccgccgtccgggccctcgtggagtccgccgaccccggggcggtgtgggccgtcggcggacccgagggcccccgggcgggttcggacggcgaacaccccgccgacgccgccttcgacgtggacggcctcagcgccgtcctcgcgctctggccggtcatcggcagcctcgtcgacgagggcgcgctgcggctgcacacaccgctcgccgcctacggggacgcggccgccgaggggactcccgccgggaccaccgcccaccacctcctcacgcacccggccgggaccgccgccctcgtccatctcacccgactcgtcgagcacctctccggcagcccgctcgccgatctcgcggccgcccggatctggcaccccctgggcatgaccggcacccgcttcgccgacggcaccctccacgcacccctcgtcgacctcgtccgcttcctgtgccgtctcctggatccgggggacccggcgggcccgccgggaatcagccgcgcctggaccaccgagtccctccggatccgcaccggcgaactcacccccgcccgcggcctgctctgggaccccgccccgcacggggtctggacccaccacgccccggggcccggcggtccggccctgtggatctccccacgccaccaccgctgggcggtcctcctgccgaccgccggccggccggcgccgcacacggccttccgtgaggccgccttcgcgccaactacccctgaatgacggctggttgtgtgagaccctgggggtcgtcccaggaggtcacagccgtatgaggaagacccgccgaggcgaccggggcgtacccggaccggcttccccgtgggacgaaatcgcaccgggcctgtggatgggcggccactactggaccgacctggccggtgagctgcggcccgtcgtcgtggcggacgagttcgacctcgtcatcagcctcttcacccggaccggccacggcccgggaccacgcgccgagcacatcgtgggggagatcccggacgccgaactcaccgcggaccagctccacaccgtgcagcgcctcgcccgcgtcgcgggactggcgctcgactcgggcctcaccacgctcgtccgctgccactcgggctacaacaggtccggcctcgtcgtcgcccagtgcctcgtcgaccggggactcacccccgacgaggccgtcgcccgggtgcgccggggccgctccccgtgggccctgcacaacgaggccttcacctcctacctcaccgccgggctggacgtcgcggcgctgctggtcgggctggacccctgacgcggtcctcggggcgcggagcgcgcaggtgggacgtacggtgatgccgttgtcgccgagtgttgtcgctcccgccgcggaggtacacggatgcgtacggtccaaggggccgccctcgacgggctccgagcccgggtacgggccctcgccgcccggcgccgccccgagcgcgcccgccggccggcccgcggtgcggcaccgctcgcggaccgcgggcccgccgtgccgcggccggacgcggaaacccccggccggcggacgtccgtaaaggaatccccgcggtacggggctcccgccccggccccgggaaccaccgcccgcgcggccctcgccggactcggcgtcctgctgcgcggcctggcccggccccgccccggcgaggtgcgtacctccgccgccgccctacgcgcgctgcgcgcccgccacggggacgcgcccgccctggtccgcacccgctccgggcggaccctcctcgtcctcctcgacccgcaggacctgcgccgcttctacgccgaacccgtcagcgtcctcgcgacggccccgccggacaaatgccggggcccgaacccggaggaggccgccgactccggctgctcccgcggtgaactccgtgcggagcggagccggatcagcgccgaggtgctggcggcgggactgcccgtgcacccctgcagcgggcccttcctcgcggccctggccgaggaggcccggcacctgacggccttcgccgccacgcccgccgccacgcccgccgccacgcacgccgccgtgaccggcaccgtgagcggggtcgcggccggcaccgcggccaggatcttcaccgccgcctccaccctcgacctcgcccgcgcccgctacgccgtacggcgcgccgcccggcggatcgtgctcggcgacgcggcagccgcggacgaggagctcaccggatggctcacccagctgcgcgccgagggcgggagcccgcgcggcggacgggtgcgcgccgcccgctcggcgcacgacaaggcccgcgcccgcatcgaggagtacgcggcccgggccgacggcgacacgctcgtcgggcgggccgcccgccacgccgaccccaccggaacgctcgaccccgtcggccaggcccagctgtggctgctggccatggacgccgtcccggacacgctgctgcgcaccctgctcctgctcggggcgcaccccgcggagcaggacctggccgcggccgaggcggcggcccaggccgccgtcggcgcggaccggggcgaactgccccggcttcgggcctgcgtccgggagtccctgcgcctgtacccggtggtgccggacctgatccgcgtcacccgcaccgagaccgaatggcggggcgtgcgctacccggccggcacctcggtgctggtgcccgcggccttccaccagcgcgaccccgaacgggtaccggccgcgcacgtgttcgtgcccggccggtggaagaacccgggcgcggaccaggacatccggatggcgcccttcagccacggcggcggccgctgtccgggcgaccagctcggcctgatggccaccgccgcgctctgcgccgaggtgctgcggggccatcgcgtcgcgggtacccggccggtgctggacccggtggggccactgcccacgacgctcgacccgcagggcatccggctcacgctcacccgccgctgagcgcgtcccggcgccccgttcgcgcccgacccgcctgacccgcccgacccgcccgacctctgtgacccgctcgacctgtgcgacgtgcccgatgccgctcgataccgcctgaccctctgcccgtccccgagcccctgccgaaccccatgaggatcacatgcccgacgccgcgacctccgcgtccaccgccccggacatcgacctgcccgacgccgcgtgccgcgccctcgccgaggccgccgacgcggtcggtgaggccgcccgctacgcctcgggcctggccttcggcgccaggctgcccgccgccgccctcacccggggcggccgtacccggctgggctggcgcaccctgctgcgtacgctcaccgacccggcgggcctcggctgggccccgcgcggccggggagtggcccgggccggccggctcgccggcatcctggcgggccgtgagagcctcgcgatcagcatcgccgtgtgcgggctgaaggcccggatccgggccgcgagcgcgggccgccccgaactgttcgacgatccgggcgcggccgccgtcctggccgccgtcggagccggccgccaggcggaggccgtccggctgttccgcgccatcatgcgcgagcgcggcgccgagcacgccttcgcgctgctggccccgtccttcgccgacatcctggcctggcacgcgctgaccgacacgaatcccttcaacgaccacgccggctggcaggtcgccaccggccgggccgagcccgccgagcccgtcctcggactcggcgccgccttctgggccttctgcgaccggggcccgggcctgccggaagggcaggccgtgacgggggccgtgcccgtacgcggcccggcccgccgccgggtcacgtaccggccgccccggccggcgccgaggccgccggccggcggcctgagcggccgcgccgccgcactgcgtacgcacgcgttccggctgcacgcggtggccgcggcgccggagtggaacggcccggagaccgaggccctgagggccgaggtcgccaggctcgcggcccgctgcgcgacggccgcgggcggcctcgccctggccgccgcccagctgaaaccgctacaggaccagtgacaggagcagcacgaggcccaggcccaccaccgagatgatggtctccatcaccgaccaggtcttcagggtctgaccgacggtcatcccgaagtactccttgaccagccagaagccggcgtcgttgacatggctgaagaacagcgagccggccccgatggccaggaccagcagcgcggtcccggtggtggacatgtccgccgcgagcggggccaccagtccggccgccgagatggtggccaccgtcgccgagccggtggccaggcggatggccaccgcgatcagccaggccagcaacagggccggtacggcccagttcctggacacgtccaggatcatctggcccacgccgacgtcgatcagcgtctgcttgaagccgccgcccgcgcccacgatcagcaggatgcccgcgatcggggccagggaccggtccaccgtggccgagatccggtcccgggtgaagccggccgcccggccgagcgtgaacatgcccacgaggacggccgtgagcagcgcgatcatcggggagcccgcgacatcggtcacgcgctgcaccggggcctcggggtcgtcgaccacgatgtcgacgagggccttgacgagcatcagggccaccggcagcagcacggtgaacaccgtggccccgaaccgggggcggtgcgccgactcggccgggggacgctccgtgatcatgcgttccggcgccggcatgtccacccaccgcgccgcgtaacgggagaacagcggcccggcgatgatcacggtcggaatcgccacgagcacaccgagcccgagggtgacaccgaggttcgcgtggagcgcgtcgatggcgacgagcggtccggggtgcggcgggaccagcccgtgcatcaccgacaggccggccagcgccgggatgccgatccgcatcagggagtagttcccccgcttggcgaccagcagcaccaccgggatcagcagcacgatgccgacctcgaagaagagcggtagcccgatcaccgaggcgatgagcaccatcgcccacggcatggcgcggcccttggcccgggcgaggatcgtgtccacgatctcgtccgcgcctcccgagtccgccagcagcttgccgaggatcgcgccgagcgcgatcagtacgccgacgcccgcgaccgtggcgccgagtccggcggtgaaactggaaacggtcttggccggaggcgcgcccgcgaagaccccgagggccagcgagccgaccgtgagggccaggaaggcgtgcagtttgaagcgggtgatgagcaggacgatgacggctatgcccgccaggacggctatcccgagctgggtgttcccggccgaggtgatcggtccggtggtggccgccgccagagtctcgacgttgagaccggtggtcacggtgacgtttcctcagttctggtcggcggggagccggcgcagcgcggccagcgcccgctcggtgatgtcttcaggggagccgaacacgtcgacgacgacaccgggttcgtcggcctggagcggctccagcgtcgcgaactgggagtcgagcagggtggtgggcatgaaatggcccttgcgttccgccatgcgcttctcgatcagcgggcggtcaccggtgaggtggacgaagacggccccgggcgccgcggcgcgcagccggtcgcggtaggcgcgcttgagcgaggaggcggcgatcaccccgccgcgcagggcggcgctgttgcgcagccactcgccgatggcgtccagccagggccggcggtcctcgtcgtccagcgggttcccggccgacatcttggcgacgttggccgccggatggaacgcgtcgccctccgcgtagggaacgccgagtgcctcggcgagcagccggcccacggtcgtcttgcccgtgccggccacgcccatcaccacaatgacgcgctgggtgctcacgcctacctcgctgtcctcgtcgacatacgttcgtgtggcaccactgaagcgcattaagtactacgtattcaagcctcaggtcggaaacatcacatcttttgtgggctggggtgtgaccgtacgcttacgtcatgaccaccgaaggcagtcctggacaggggcaggggctccacacccacgtgctggacaccctcgggctcgcgatcacggcgggggagtacccgcccggcagcgtcctgcgcacggacgagatcgccgaacgcttcgacgcctcccgcaccgtcgtacgggaggtcgtccgcgtactggagtcgatgcacctggtcgagtcccgccgccgggtcggtgtcaccgtgcgccccaccgaggagtggaacgtctacgacccgcgcgtgatccgctggcgcctggccggcaccgaccggccccggcagctgcgttccctcaccgtgctgcgctccgcgatcgagccggtcgcggccggactcgcggcgaggctggccacaccgcagcagtgcgccgaactcaccgaggcggccctgggtatggtccgcacctcgcgcggccaccagctggagggctacctgcggcacgacatcgccttccaccgcgtggtgctgaacgcctcgggcaacgaaatgttcgcccgcctcggggacgtcgtcgccgaggtgctgaccggccgcaccgagcacgcggtgatgttccacgatcccgaccccgccgccgtcaccctgcacgtccaggtggccgaggcggtccgcgagggcgacgcggcgcgcgccgaggcgctgacccgccggatcgcggtgggggcgctggaggaactggacgtactcgcgccctgagcgcagctccccccggacccgggggcaggggcggggtgtcagccgcagcccccgcagccgccgcaccctccgccgcatccccctccacagccgccgccgcatccgccacaggtggaggagtcggagctgcgtgactgcgcccgcgcccgctcccggtcgcgcctgcgttcctcgtcccggcgcgcctgctcgcgcacggactcgcggtacgagcggcccgccggcctccattcccgcagcccgtggcgccggcgcgggagcagtggggcggccgtgacggctgagacgaggcggacgtcctggtcgtagacggcgctctccaggaggacctcggcgccctcgtacacggctccgtacaggacggcctggaacggttcccggcgcgggtcgatgtcgtgatggtccgcgcgcaggctcggttcggagcgggcgagcaggatccgctgccccgcggcggtgtccccggctcgcgggaaggcggcgatcagaggcggggcggtgggggtgtcggcgtccgggcacagccagtggtgtccggacgcggaggcccgtacgccgaccaggagcacgggctgcggccgcccgcgcaggcgccgggccgcccggcgccgggccaggttccggccgagcgcggtggtaccggcgaccagcagcagcgtggcgaacagccgcccgccgaacggcccgtacgggtgggcgagggctccggcggccgccaggcagcacacggagccgaggacgatgcccggccgtccgcggcgcaggtgggcggctggaagcacggccggcaccgggaagcgggcggatccggccgcggcgagggccagttcgcgctggcggtgccgggcgcgcagccggagcaccgcaccggtgaacgcccacgcggcgacggcggccaccagcccgtgaccggcccggcccgccctgtcgggggagccgggaaaggccaggacggcctcggccgcgagggcgggcgcggcgagcagggtggccaccggcatgtaccggaaccagaacggcagtgcggccagcagggcgatcgccgcgaaaccccgccaccccccggcggactcggccgtcagcgcgacggcaaggaggaccgggcccgtgaggaggcgggcaccggcggcgggcgcgaacaccgccggcacgcgggcccggagccagcgcggggcgttgtcggcaccccacgccgcgaccgggccgcaggtgcttgacgtagtcggtcacggcgccagtatgtgagcgccgtgccgcggcccagaagaggatgccgcggcacggaatcgctacggccgcttccgggcggcggacacccggcctcagacgtcgagcgcggcgatttcgagcgcgccgatacgctccggttccgccacgatgtcgatctccgtgatcagaccgtcctcgatcgtgaagccgagtaccaggaacagccgtcccaggggggccatcgccaggccgaccactccgtcgaccagggccggcaccgtggactgcgcccgctgcatggcggccatggctcccgtggcgacggtgacggcgccgcggacgaggagcgggccgggggtgggtccgacggccttgtcggcccggagcaccacgtcggggtggagcagggcgacgagcgcgtcgaagtccccgccgcgggtggcggcgaggaaggcgtccacgacccggcgccgtcgggtcagatcggcctcgggcaccagcggggcccccttgacccggcggcgggcgcggctcgcgagctgacgggtcgccgccggggtcttctcgatcagcggggcgatctcgtcgaagggcacggcgaacaggtcgtgcagcacgaacgccagacgttcggccggtgccagctggtcgaggaccaccagcagcgccagccccaccgagtcggccagcagggcctcctgctcggggtcgaccgtgtcctcacggctgacggcgggatcggacggataggtctccatggagtcctcgcgccgggactcgcgcgagcgcagcatgttgaggcagacgcgcgacacgaccgtggtcagccagccgccgaggttctccacctcgctgacgtcggtacggtcgaggcgcagccaggtctcctggacggcgtcgtcggcctcggcgagcgagccgagcatgcggtaggacaccgctctcaggtgagagcggtgctcttcgaaacgttccgtcaggtacacattcccgtccacgggtcccccacatagatcgcgtacagcggatgatcaaaatagatcatggggggctgctggataatggcccccgaacagcagaagcgagtggagacgccggggccgcgtgcggttccggcaggagagggagcccccgatggacgtgcagcacttcgagcggatcaccgcattcatcgaggcgcggctcaccccgctgttcgacgaggcgacgggcagcgaacacggcttcgccatggacgacacctcccgcgccctgcgtgcgctgcgcaactccgtcctggaggcctccgccgtcaagggcctcatcgagaagcgggaatccgcggagccggccatgcgccgtgtcatcgaccagtcggtggagcagaactgggacgtgctgcgcgggatcgcccgccagtgggaggaccacgccgacttccgccacgagttcaagcaccacgcctgggagctcgaccaccacgaccacgccgccgccaaggcctgagctcaccgcggcggttcggggaccgcgctgcgcgcggcgagcgccgcgcgcagcagcgccgccgtggcggactgctcggcgggcgacggcgacaggacgccgttctcggtcatcagggcgtggaactgctgccgttcgtacggaaccccgggaggcagcgccgcgatgtgccagtgcaggtgggcgttgccctgccggctccccagcgagtacaggtaggtccgctcgctgtcgaggacgtcctcgacagcgagcgcgacctcccgcacgaccagcatcagccgggtgtaggccgtggcgtccagatcgcgcacggcgtgttcgatgtgcgccttgggagccaccaggaccttgcaggggagggtgggccagcggtcgaggaaggccacgtgctgctcgtcctcgaagaccttctcgtgcgcgtagtccgggtgtccggcgaggaaggcgcagacgaagcacggcccgccgcgcgtccgttcgacgtaggcctccagatccatcggtccacggtccatcggcatcggtgtcggcatcggcccatcctcccaccggcggccgcccgtcacagggctgacgggacgtcggtgtggtggccggtcaccaccagtccgccgtccagggtgcgccgcgcgaggacgccggtgcggaagtacccgtcgggggtgaaggagcgtgcgttgcggtcgggcgcccggtagtaaccccgcagggtgcgcggaccgcgggcgaggagccggccgggttccccctcgggaacgtccacgccgtcggcgtcgaccacgcggatctcgtcgccgggcgagagcgggcggccctgcgtgggtgaggacggtctcgtccggatcggcgggccgggtgagggtgagcagcccctcggccgtgccgaggacctgctggaggcgacagcccgacgccgggcccacccgttcggcggtcgcccggtccaggggcccgccaccgatctgcacgagacgcagactgctcacgtcggcccggaccctgggaagcaggtcgagccagagcctggcggcggcgggctccagcgacgtgatggtgacccgctcgcgctcgacggccgcgaggcacccgtcggccccggggccctcgaccaggacgacggtgccgccgacggagagcgtgccgaggatgccgggacagccgaaggcgaagtcggacccggcgggcagcgccgcgaggtacacgtcgttcgcggtcagcgacaccagctccgcggcggcccgggcctggtaggcgtagtcgttgtgcgtgcgcggagcgagcgcgggctccgcagtggtaccgccggagggcaggaagaaggccacctggtcggcgctcgatcgacccggtgcctcgaaggtgaacacccgcctcaggaaggggtcttgggcggcgatgtccgcggccatcccggtgaggtcgaagccccggtgggccgcgggaccgacgtagccgacggcctggccgacccgcacgaggtgggagacctcgcccaggcggacgagacgtcagtcctggctggctgcttaccaccgcggacagcgaggtcgcggaaacggcggctcagctcttcggggggacgccgatgcgccgcgctgcatcaccagacgtgatcgacgtactcggcaagatcgcggcgaggaagcggatcggtcccgagcctgaagtggagctgcgccttcggcttcaggccgcgcccgcactcggcatcttccgcctggagtcctcctcctggtcgctggctgagtccctggacgaggtgggggtgccactgaagggtgaggggagcgacgccctgctgaagatccggattcggcatgctcgtgtgtcccccaagtcggggagggacgtcaggtattcgtggcccgtcgtcgcggtggcagaccaactcgacggcgctcgacaggacgtggccgcgtaagcacggccggttgagcggtatccggctcatgcgttgctgccatcgaccatgaaattgacgagtactcgcccgataaccatggcgcgacagacgttctggaactggatcggacggtcccaagaggatattgcaggcttccgcgaagactggatgaacggcacccgctatggcgaggtgaagggctacggctgccctccgattcctgccctggaactggcccccaactcgcttgaagtctaggggtgggacgcgctgaacagcgctgatgtcatcatgggtgcgggctgtacgtggcggctcacatcgttccgattgcgagggtccggcgggagtcgaaatgatctctgcagcgacattttgatcttgatgccgagtctcatgtggaccaggctgtggtcaggtctagtcgaacgaatgctgacactttgctgacgctactgacgaggcgcagcccgctgagggccggggccgcgagctcgccgtgtggtcgtcccgcggccgtccgatcgggcaccgcctgcaaccggcgttccggtcggtgcccgtgcaccaccggcctgcctaccgaggcagcccgtgcgggtattccttcgaggagcggtcggcgggcggcgggtcgtggtccacggggaagaggggcagggcgccggtcatctccaggaggcgctggagctggtggttgggggctgccaggcggacgacggttccggcctcctgcgctgtgagccgcgcggcgaggagtgcgttgagcgcggaggagtcgcagaaggagacgcggctgcagtcgaccgtcacgggcttggccggtgaggcgtgggcgagggcttgggcgagagcggaccgcagggcgggggccgtctcgatgtcgatctcgcccgagggcctgatggcgacggcgtgatccaggacttccacggcgatggcgttgccgccggcctccggggaagggcgttcgaccatggtgggtactcctcggttcgtggcgtggcccccggaccccgtggcctgtcgagggttcgggggaggggagggtcaggtgctgcgctggtcgtgggtgtcctggcggagctggtcggtgtgccgggtcagggcgtcgatgcgttctgcgagctcggcgtcctcgggccgcaggtggtcgcgggtgtcggccaggggtcggacgaggcgggcggcgtcgttgtcggcgagggcgaggttcaggtctccgacggcgccctcggcgctggcggggagatcggtcagtgcggtgacctgggcggcgagccggcggaggtctgccgcgtggtcacgggcccacgcggtcacggtgcggtcggcggcacgtgtgtcgcgtgtggcctggacgcgctgctcgccggtgctcccggccgctcccgggcgcagccgcaggtagcggcgttcggcggcctggcggcttgcgaccccgagcgggcccgcgaggtcggcccagctcgcgccctgcccgcgggcggtctcgatcaggccgctctcccaaccggcgagctgctcgcggacctcgcgcagcatcaccagcgcggccagagcggcgtcggtatccgctgtggtcgccgccgctccggccgcggtcgggcgtgcgaagggcttacgcgcgtctctcacggcctggttgatcgcctccagtgccgcggtggcggccaggaaagggatcggctcgggcggctcaggggtctcgttcattaccgtctccagtccgtcaccctccggatgacttcttgcttgtcatcgtttcgatgacatgttacaacgggagcacgttgaagcgcattggcagtttctgcctgaaccaactggaggtgtttcgcgatgttgatgcgcaccgacccgttccgcgagatggaccggatcgtccagcagctttcgggcacgtcgggtacgtggtcgaagccgtccgtgatgccgatggacgcctaccgtcagggcgacgtctacgtgatcgccttcgacctccccggtgtgagcaccgaggcgatcgacatcgacgtcgagcggaacatgctgacggtgaaggccgagcgccggcccacggggaagtccgacggcgtgcagatggagctctccgagcggcccctcggcgtcttctcccgccagatcatgctggccgacaccctcgacaccgagcacatcgaggccgactacgacgcgggtgtcctgaccctgcggatcccgatcgccgagcgcgccaagccccgcaagatcagcatcggcggcgagagcggccgcaagcagatctccggctgaccagaccggcaccagcggcggaggacggggaaccgatccccctccggcaccccgtcctccgcaccccctcggaccgttcgccctccccggaggtgacgtcatgacgatacgcagggagtcgttccaggcacacgtccaggaacgcggcgagtaccagaccccacaggaagcggaacgggcggcccgcgtcgtcctggccctgctgggcgcccacctggtcggcaccgtgcgggccgaactcgccgcccgactccccgaaacgtacgccctgatcctgctcaacccgctgcaggccgcggagccgctcccgcccgagcgattcgtgcgtgcgaccgcggcctggatcgagggcgccaccgagaagaccgccctgtgggacatcggcgcggtcctgtccaccgtggccgccgcggcgggtgacgtcctcacgcgcgaggtcctgctccagctcccgcccggctacgacctcctcttcggccacccccagcccacctgaccggcgccgactgacgcaacgtgaactttcgaagagaaaggcaaccgcagcaccatgtaccaccagcctcgaccggaccggcccacccccgccatgacgttcgaccagatgctggaacgcgtgcgctacgaaggcgcctaccccacccgcgaacgcgccgcggaagccgtccaccacgtcctgtccgccctcggccgccagctcaccggcgacgaacgagtcgacctcgcccagtgcctgcccgtcgaagccgccctcaccctgaccgcccagatccccgacacccagcacctcaccggctggggcttcgtcaaggacctggccgcccgaaccggcgtgagcccggccatcgcccgctgggacaccggcgccgtactctccgccgtcaccgcgctcgccgaccccggcctcctcgcccggatcctgcaaggactgcccgacgactacgccctcctcttcggacaggcgcgactgtgccggcctcagcgcgccgccgcctgaccggagccgactgcgcgcggacatgcaacggggccgggaccgttactgccgccccggcccgttgcgcacgagcggtcagtgcttgaaggtgtccttgaccttctccttggcctcgcgggcatcgcccttggcctgctccgctcggccctcgccggtcagccgctcattgcccgtcaggcggccagcggtctccttgagcttgcccttggcctgctcgccctttgcctcggccttctgctcaccagacacagctgatcactccctgttcgatggaaaggtcttaccagacccccgtatgaccggcgggatccgtcctaaacagacggggcgccacgaggcgcatcggtctgagtgccggggtgggtgcccgaccccctctccggcggcagtgcgatcccggctgctccttggtcccgcgctcggcagcctcgggatgccatgcgttggagttcgattacctcctcatgcgccacacgaaaatctatgacgaccgaagtagacattgggtggcggcgtggttatggtttctctcgtagcccagagagaccgaaagggcctggcagagacgaactgccgggcagcagtacggcattacccgtagttgcagtgcatatgacggtccggtggtggagtttcgaagccaaggttgttgcaggacggcgacggggctgacgaccggaccgggtggcccgcggtgatcaggggccgccgtgagcagtgccgcagtcaacgcagcggtggcagtaccggtaagtgcagtccgcagtactcagcagtgaagtcagtgagcagcacctcggtgaaggcgtcggctgcaggcgcgcgcaccgggaagttcggcagtggggttctaagccagagcagacgcaggacgggcgacggggctggctgccggagagtggcgctgagtcaggccaccagtagtacgcagtagagcagtaccagcagttgatcaccgagggaagaacggaggagccgagcgccatcaggatcgcccgggtcgaagactgagcccgggtaccgcaggacatcgacagtgaggtggtctccggtcaagcaaccgcgatccccgcacccccggcaccgtgccggtcgggtcagcggacatggaacgccgacgcagtatgagggtcggcagatggtgtagcagttccttcggggccctggtgccatacggcaccagggcccctccacgcgttccacgagagagacgtgaacgaccgcagacgactcgtacgaccgcctcaaccacgacgactaccccgcctacaccatgggccgggcggccgaaatgcccgacaccacccagggcttcctccgcgctctgggcgacgcccgcctcatcaccccgctccgctccgcaggcgggcaccgccgctactcccgctaccagctgcgcatcgcggcccgcgcccgcgaactcgtcgaccagggcacccccatcgaggccgcctgccgcatcatcatcctcgaggaccagctcgaagaagcccagcgcctcaacgccgaataccgccgcgccgcccaagcaaccaacccctaccgcgacccccgagggctaaggctcggcccgcacggcatcgcagccgatgctcggaggtcctgaatgggcacgcatccggtggctttccccaaaggtgcggcccggccacagcacgtgggcccgtgaccggcaagatcccggcatgcgcactggacggaacctcgtctccctccgctcgacgtccgcgcggcccgtggtgctcggtgcgggagcggccatcggcaggtcgtacgcctgcctcaggcatctgcccgccgcgaccgcacccgagggggtgcggtcgcggcggggacggggtctcacatggcggcggggaagcgttcccagacgcggtgggctgcgagcagttccatgagctggcgcattccctgggcgccgtcggtgacgacgacgccgggttcgccgaccgagatcccggcggcctcgaagagggcttcggccccgcccaagccgatgagcgccttgccgtgctggtaggcctcggtgagcagagcgaggacccgagggtcgctgacgggtggcctgggggctccggccttggcatcgcgagcaccgtaggcgtcggcgcccgctccgggcacgcccgcgaagatcagcgcgtcgaattcgaccgagcgggcggtggcgaaggtgcgctggaccgtcaccgtgtcgtcgccggtgcccagcactccgcctgcggccgccacgaccagcggcaccattccggcgtcgaggatggcctggcgcaccccgttcacaccgaccatgtccatggcctggccggtgacgatgccaatgacgcgtccgtccagcggccaggtgcggccgacctgggacagggcggggctggggcgggcatcgacgagcacctcggtggcggccggcgctggcaggcccagtccggccgcgacctgggcgcacagctcggggtcgatgttggcgagcacgccgagagtgcgttccttgatggcctgctcgtagcacttggccagttcgaacgtgtaggcggcgatgatgtgctcgcgctcgaccgggctcatgctgagccagaacaggcgcgcctgggagaagtgatcggcgaacgaggcgggtgcttcgcggaccttgcgtccggcgggaacctcgacgggtacctcgatgaacgcgccggtgaacgtgcccgtgtcggtgcccgcgtagaaggggcagccgccatcgaggctgttgggcttgtagggagccacgccccggtgcacggcggtctggtggaagccgtcacgcagcatgtcgttgacgggtgcgtgggtgcggttgatcgggatctgcgggaagttggggccgccgagccgggtgagctgggtgtccaggtaggagaacatccggccggccagcagcgggtcgtcggtcgcgtcgatgcccgggacgaggtgtccggtgtggaaggcgacctgctcgacctcggcgaaaaagttcgacgggttcgcgttcagcgtcagcagcccgaccggcttcaccggagcgagctcctccgggacgatcttcgtggcgtcgaggaggtcgatgccctcgaacgtctggtcgtcggtgtcggggaaggtctggatgcccagctcccactgcgggaaggcgccggactcgatggcgtcgaagaggtcccggcggtggaagtcgggatccaccccggcgaggatctgcgcctcctcccacaccaaggagtgcacgcccagcttgggcttccagtggaacttcaccagcgtcgaggtgccctgggcgttgacgaggcggaaggtgtggaccccgaagccctccatcatgcggaacgagcgggggatcccgcggtcggacatgttccacagggtgtggtgggtggcttcggtgtgcagggacacgaagtcccagaacgtgtcgtgcgcgctttgtgcctgcgggatctcgcggtccgggtgcggcttgccggcgtggatgatgtcggggaacttgatggcgtcctggatgaagaagaccgggatattgtttccgaccaggtcgaagacgccttcctcggtgtagaacttcgtcgcgaagccgcgggtgtcgcgcacggtgtcggcggagccgcgcgagccgagcacggtggagaaccgcacgaacaccggcgtttcggtgtcccgggcgaggaacgcggccttggtgaccgtttgcgcggtgccgtaggactggaagacgccgtgcgcggccgagccgcgggcatggaccacacgctccgggatccgctcgtggtcgaagtgcatgagcttttcacgcaggtggtggtcctgcagcagcaccggcccccgggagcccgccttgagcgagtggtccgtgtcgggcatacgtacgccctgcgcggtcgtcagatatgccccgctctgtgcgaccctggcctggtccgcgccggtgggctgcccggtcggactcacagtctccgggccgctctgatctgccttcggcggcagcggctctactggctcggtcggctccaccagctgcggggagaccggagcgggcttaccggggacgccgtcctccggtccgtcggtcggcgcggcgtcgccgtgcaaggcgccggtgatcttgtcggtaactgccttgaccggattcttctcggacatcacatctccagacacaggggacaggccctacacgtgtgacccgaaaccatgcgttcggaaacggcgactagcctgtccggacctgtgaccgacgtccaaggcggcgagacccgctgaccggtgtccgaccagcagcgagccaaaccggcccgctggccggcacgcccgtgcggaggggcccagctctcctgggccgtacaccgacgacgcacccgtcagactcaagtgagacagatccgggatggccaacgcccgatgagcctgctgccccctacgcgcccggattgcggcgtccagtcctcgacggtagtgaggcatcggcgaggtcggccccggtggccgcgtcacgctgggagtttccgatgccgtgccagtccaggcacatgacggttgcgtcgtcgtccagatgaccgttgccggcgtccacgatcgccccgatgagggtgcgggcggcttcgcggggatgcagggtgcgggtgcggaggatcaggtccgagaggtcgagattttcggcgttgcgctccagcatgccgtccgtcagcatcaccagccggtcacccggccgcaggtccagcgtctgcacccggtaggtgccggccggcgatgcctggacattgaggccgaacggtagatcgacttcgggaacgatctcttgcacctgcccgtcgcgcatccacagaggccaggggtgcccggcgttgacgaactcggcccggccgtcgagcaggctgatgcgcagcagctgaccggtgacgtaaccgctgcggccgtgatcgcgcatggcctggtcggcctggcgggcctgttcgtcgaggtcggcgcccgcccgccgcgcccgccgcagggcacccacgacgagggtggccaacagcgcggcgtcgacgtcgtggcccatggcgtcggtgacggagagctggaccgtatcccggtcgatcacgtagtcgaaggtgtcgcccccgacgtggtcggcgggttccagggcccctgcgagcgcgaactgggcggcctcacacgccagcgatgccggcagcagccggtgctggatctcagcggccaggctcaggggcttggtgcgtcggccccattggtacacatcggtatgggaccggttcgcgatgacgatgtacgccagcgcgtgcgcggtctcaccgatctccagcatcacttcggcgctcggagcggcgggcaggaacagctccaggagcccgatggcatccccccggttggtcaccggggcgatgacccgcaccagctcactgtcgcccctttcctccacctgcggccgctggctgcggatcacatcgtcgtacagggttccccgcagccgaatgcgcgcggccggctcaccggtctcgacgctgcccgcagcccccagccgtacgaccgaactgccgctgaagtcagtgatcaagaacgagaccgaggctgccccgaggtgctccttgagcatgcgcgcgaccacatcgagcgactccacgggcgccgcggcctccgcagcctccaacgtctccgccaacgtcatcgcccggccaggtcggctcccgctcatggggtgacgagaggcctgcccgtcgtccggctctcctgcggtcacaacgaccccttatcgcgtgatggcggccgggactcgtcccggatcggcaagacccgcgccaaggcggcgtcgcacagcacattgcaccacgggacgcccaggcggccggagatcccgcagccgcgcggcgacaagtacaggcgtcggctcggccgtgtcggcaacacgccgcgccgacaccctgctaccaggggagttcctcgcagatgatcttgccgccaccgactgctggtctgatccggatgtgggttgcgaggcgctgaatcatgaaccatccccaccaacccgtcccgtccgtgcgagggaccctcggctcgggcggccgggggctgcggtcggagacgcagacatcgacggcgtcatcgaacagtttcagatggagggaagagggaccgtcggtgtgtcgaatcgcgtttgcaacgagctcggccaccaccaggaggacgtcatccatgctcccgcccttggtgggcgcccgtagccgggctgcgcgcgcaaggaaggcacgggtggcctcacgagctgctgctccgggccagccaatacgagacagggactggtccaggacggctgtggtcacctgttcctccttcgcccggcgtgcctgtctggcggatgccccgctacgcgaacggaaaccgcgacgccgtctgccgagtgcgcacagaggcgactacggaccgctgcggcacggtcatgggtgcgtccgcagccgggcggataaggcggtctggtgttcccagcctcggcgtgacacgctcaaggggaaccagcctggtctggtgggagaccccacacgcctgaaagcgaccggcgggtacgggtggtctcgctcggctgtgagtggccttccgacggctgcacgcttgacggcctcctccgcgcacgccgggagccgaccgtaatgggcttcgatcccgaacggcggaccagtgatgctccccatcaggtttcaactcggtgtcagtgtgcaacccgacgcgacggttgtgaccgtggcaggcgaactcgacatgaccacctgcccctccatcacccaagccaccgacaccctggccctcaagggtcagacccttgccctcgacctgtcggccgtgacccacatggactccagcggcctcaacatgctcctcaccctgcgcaaccgcgcccgcgccgagcacggcgagctgcacctgcgcggcgtcccccgccaacccctacgcgtcctcgacctcaccggcacccgcagcctcttcaccctgcgcccctgcctcaccccatgagatccgcgcttgcagccggacagggcgggcatgcgcaaagggaaccacgggtcgagtgccgccgccggcaagcccgcccgccgggcgagaagcaccccagtgcgagcggcgccgcgccatctggaggtctcacatgtctgttcccaccggcaccgccccccttgcagcactgtccgcggccggagtggcggtctggctcgacgacctgtcccgcgagctcctggccggtggagagctcatcgagctggttgccgaaaagcacgtggtgggggtcacgaccaaccccacgatcttcgcctccgccctgtccaagggggaccgctacaccgagcagctgcgccgcctcggcaacgcgggaaccagtgtcgacgacgcagtcttcgccctgaccacggacgacgtgcgaagcggctgcgaggtcctcgcccccgtccatcagcgcaccggaggcatcgacggacgggtctccatcgaggtcgacccgcgcctggcgcaggacgccgatgccaccattgtccaggcccgaaagctgtggcaaacagtcgaccggccgaatctgttcgtcaagatcccggccactcgtaaaggtctcacggcgatcaccgccgtcatcgccgagggcatcagcgtcaacgtcacgctgatcttctccctggaccgctaccgcgacgtgatggacgcctaccaggcaggtctggaacaggcgcaggcagcgggacgcgatctgtcggacatccactcggtcgcctcgttcttcgtctcccgcgtcgacagcgaggtcgaccgccgcctcgacaccctcggcaccccagaggccctggcgctcaagggcaagacagcggtcgccaacgcccgcctggcatatcaggcgtacgagcagatgaccgaggagccgcgttggcagcgcctcgccgcggccggcgcccgcgttcagcggcccctgtgggcgtccaccggggtgaaggacccgtcctacccggacacgatgtacgttagccaactcgtcatcacgggcaccgtgaacaccatgccgagggccactctggccgcattcgcagaccacggcaccctccccgtccacccgccgacggcgaacgactacgcggccgccggcgcccacctcaaggcgctgcaacgggcgggcgccgacatcaccgacgtcaccgacaccctggaacgcgaaggactcaccaagttcgaggacagctggcaggagctcggcgactcggtggggcgagaaatgcaccccgaagccggcgacacctgcgacgacaccgggagccgaaatggaggacccgaaagcgcccagctgctcgcgatctacctcaacgaccactattcggccgctaccgggggcctggaactcttccggcgcgccgcagaggcgcagacgagcacagcggcgcacacggtactgaccgaactgacccgtcaggccgatgaggaccgtgactcgctggcacagatcatggccgctctggaggtcccgatcagccactccaaggcggccatgggctggctcgcggagaaggcgggccgcctcaagaccaatggccacctccttacccgctcgcccctcagcgacgtcttggaagcagagtccatgctcctcggcgtccagggcaagaaggcctgctggcggaccctgaggatcctcgccgacaccgacgaacgcttttccaccaagcacctggacgccctggcggagcgcgccgagaagcagctcgtgctgttggaggagctgcgcatctcggcagtcacccgggcactgcgtcctcgactcttcagcacgcggtaaccccgggagccgccgcttccgccatgcgagggcgaatggacgccctgcgtgtacgcgcggccctcggggcgagtgcgagtagcggggcagatgcctcccgacagggctccgcccggtagcgcaaccgtgccggcccggtcggcgtcccgggccggcgtccgctcgcccgaggccgggacaacggcgcggggcgggaagtacgtcgatgtcgacatcccgggtatgcgcagtacgacgggagcgtcacccgcgagccgggtgggctccggcacagggcgttccgcgcgtgccggggccgctcctccgagacagactacggaaagcgactcttgatcatgaattcctcccaggcgatgcgccctcctcccgtacgggcggattcggggagcgacttcgcccgactctcccggaagatccaggaggcgggtctcatggcccggcgccccgggtactacgcactgcgcatcgcggccgtgacggtcctgtacgccgccgggtggacggccttcttcctgatcggcgacagctggtggacactgccggcggccgccttccttgctctcgtgttcgggcaggtggccctgctcgcgcacgacctcgcccaccggcaggtcttccgactgcgcaaggccagcgaggtgtccgggcgcatcgccggcaacttcggcatcggcatggggtacggctggtggcaggacaagcacacacgacaccacgccaaccccaaccacgagaacctcgatcccgacctcgacccggacatcctcgtctggacgcaggaccaggcccgcgcggcgagggggctgccgcggctgctcggccgatcgcaggctttcctcttcttcccgctcctcaccctggaggggttcaacctgcacgtgtccggggtgcggtcgctgttcgaccgttccctcagtcaccgggtgtgggagggggccctgctcaccgcgcacttcgccacctacctcggcgcgttgttcctggttctgccgccgggcaaagcggtcgtgtttctcctcgtccaccagtgcctcttcggcgtctacctcggctcgatcttcgccccgaaccacaagggcatgcctgttctgcgaggtgacgagcggcccgacttcctgcggcgccaggttctgacctcccgcgacgtgcgcggaggccgtttcacggacatcgtgctgggcggtctcaactaccagatcgagcaccacctcttcccgagcatgcccagcccgcacctgcgcagggcccagatcatcgtccgggggtactgccaggagctcggggtcagctacctggagaccagcctggtcaactcctaccggcagaccctcgccagcctccacgcggccggagcccccctcagagcgccgcgcaccacctgatgccgccacgcaccccgactgggacgcgggtcaaccgttccgcctcaggacggtgccatcgtctgtgccgtcctcttcggctattggagaaggatgtcccggcggtgggtgtccgggcagggccccatcgccgggaagccgtcgcgcgccgagcggggattggccgacggcggcagattcctcacgccgcctctgccgtggggtcacgagtgtggccggctcgtgttgacggggccgcgaggtatcagcctgacgcatcgcggtcggagcagtggagcgcgtcggagggcgacggggttcaacggtgatcggaagggtaggcgacggccacctgttggatccgctggcgaaaggcaacctcccatgttgatggctcacccggctgtgcttcccggcctcgtcgaccgttactgggcgctgtccgtactcgacgccgcggaaggcgactctcccgtacgcggggagatcgaggacgtcgagcgggcgctctgcgtggccactggcacgacggacgtgcacgccgccctgattgccgcccgccaccacctgcccggcacgggcgccctcgatgactccgtgctcgtcaccggctgatcgggttcagccgtcagtgggcgctacccgcccgcatgcatccagaggaaggatgagaggcgtgaggttcgtgggcaggcgcctgccggaaggcgggcagtttggcgtgcaccgaccgcggacggtgcccaggcggcagctgcccggtgaaggtcacccgattggacgtgaaggggtgccaaggagcttggtgcggcagaggctgggcccatggccgccaagctgatcatctacccgcccgaccagcagggctggcgacgagtccgctatgacggcgtgcccattggagtggcgcatcgcccagccgatgtccgagccttcctcgccgcggcaggtagggagaacgccgaggatgtcgacctcaccgaccctgacttcgtggagtggcggggggccggccccgaggtgtgggaaccgtctccctgacaggcttccctgggcggacgtgcggcaaccagaggagcagggcggtgacggagacgggcccgatcgttgtgttcgcgaacttcctctcggacttggcagtggatctcgacgaggggcagatcctgacgacgtgggcccagcaggcgccgcggaaggcgtggctgcttcgaccaggggacgtgttcgtcactcccgtgcggttgagccgggagttcttgcgctacgtccacgacctcaccggggtgtccccggaatcggtcgcggtgatcgaggtgcctcctgccggagccgttccgctggcccgggcggtgcgcgaggccggcctcgtcgagcaggttcgggcgctcgcctgcgaccggggtgcggcgctactgccgacggctttggacgcgtcggcgatcgcatttgcccgggacatcggcatcgacatccacccgtatcccacggtcgaggccgcagaggccgccctgaagacgaccatgctgctcaacacgaagaccgggttccgcgagacggctgagcagctgggcatgcagctgcctgcggggcggatgtgccggcgcccggaggtcgaaggggtggcgcgtgagctcctgcgggaccacgagggcgtcgtggtgaagcccgaccgttccgccggcggacacgggatgcgcttcgtgtcccgcgacgggctgaggggcggggcgagcctgccgctggatacggtcggtgggcccgagggcctatgggtggtggaggagtgcctcgacgtggccgagtcggtcagtgtccaggtggaggtctccgcctccgggacgcgcgcgctcttcagcggagcgatgcgcacggttcagggctctttcacgggctatgtctctccgctgccgccgtcctgcgcgcacgtggccggcgagctggaggagtgggggacggccctgggccgctaccttgccgaccacggctacgccgggcccttcgggctcgacgccctggtggacacggacggcgtcgtgtacgcgagtgagagcaacatccgccgtacggccaccaccacaccccacgccatggtcacccggctgacggagggaactgccaacgcacacccggcatggtcggtgtcgaagggctggacacggactcccatggacttcgacgaggcgcttgcccggctgcgcgcctcccgcctcgccttcgacccggaccgcggcgagggcgtggtcctttacgccgacgcaccgcccgacggtcgctcctggcggtatgtggtgattgccaggagcgctgcggacgtcgaggagcaggaaacccccttggccgaggtcctcgatttcgaaagtggctgaccccgccacgaagccggtcccggcacccaaggggtgccgggaccggcttcgtggcgggggtgcgatcaggcggggcggccgccgaagggggcgccagtgccgtagtaggtgccgagctcttcgcggtagccggtgtcgccgaggtgcttgtcccggtggaactcgggggcgttcttgatctgttccttggtgcggtcgacgaagatcttcttgtcctccgggtcgaccttgacgaccgtgctggccggcaggaggacctccttgccgaagatccatacgccggtgtcgaccaccaggtaggcgtcaccgacctcgtcggagtgcttgtcgaccttgccgatgctgccgtcggtcgcctcgaccttgtagccggtcaggtccgtaccggccaggtggcccgcggtcggctggtaactccacacattctcagtcacgcgaaaacaactcctcggtcaacggagggggcggcgggagaatgaaatctccaccgatcctccttgttccgtacgtcgtgctcggcggttgcgctgcgttccgcctgaacttcgtctgccccgccttttcgacttcacgcacccggatcacattcgagaccggggcggccgtcgatcattggaggcgagcaggtcccctgctgcatcacggcgaccgtccctgctgcctccgaatgcccccgctatgctcctccattcgttgcgtgtcggcgaaggcctgtcgacaatgacatggcggtggccggccaccccaaggaaggggtggccggccaccgccgtgcagagtcagaactgcgctgtcgtacggctaccagcggtaccagcggccactaccgcccttaggtcgggcaacgaaaccgatcagccacaggatcaggactgcgatagccacccaccaaagaatcttcaccgcgaaacccgcgccgaagaggagaaggaccagcagaagaacgagaagcaggggaaccatagttatcaacctccgaagcgccatctgcccgaccgcatccgggacatgcatgcgatttttatgtgttttttatcccggtggctgggcaggaggtcttgcctgcatcgaacagcaatcaggagatggatccggcacaccaagttccggacggcgtcgacgagaacacgggtgcgctttcgaaggcgctggaaaccacggagcgggcccgtggccacctctacgggttccaccagctgaccgggactgcggacttcgagctcggcgacgcggtgcggctcttgcgggagtcgggctgcgaggagcaggccgccctggtcgagcgtgagatcgtgggccgcaacgtcatcccgggtcgctcgacgttccagattgtcgaggcctgcaactccaccctcctgacccaaggctcggcttggcgaaggctctgggggaggcctaccggagctcagctcggatcgggcctcatcagagggtactgacggggcgcgtagggcccctcacgttgcggcgtgcgctccgacggcctgccggtaggccacgtgtccgcccagactgcccagccggcgaccgctgccggtgcgacgccggccagtccgacggcggtcagagtggtcgccgcgtggtgtgccccgggcacgaagtcgagtaccgaggccgacagccagcatccgatgggcacctgcacgagcacgggtgtacggggtggcccagaggtctgccgcgcagcagatcgcgcatgccgcccaggggcccgctgccacgccgccatcccggcctggcgccgactgcacccgaacgaccggcccggcgagggggagccgcggtcttcatcgccgtcctactgcgtcggcccgcgcagagctcttgctcgcgggggcgggtgttgaggcggtgccggggtatgcgctgtgcaagaacgtggagcgcactcgcgcatgagccagaacaggccgttgaggctctggccgccaaggccgccatcgaggcccgaaccaaggagaagaccgccgccatgaagcagcaaagcgccgagaaggcttccctgatcgccgatcagatccgcgagaaggcggaacaagccgcccgcctggtgcgggacaacacccccgactcggtcctggacaatgccgcccatgccgtcacacaggtgtgggacggcgcgacccgcgccggacagtacgcggcggacaagacccccgacccgcttctggagaaggccggccaagccgcgacggccgcacgaggcaaccgcactccgctcctggtcgccggcgctgtgatcatcgccctcgtgctggtgcgccgcagccgcgcgcgtcgccgatgaaggcccccaccgctgcctacaagcccctcggactcctcctcggagcggcgagcggcatggtcgcgggggccgcgttcaggcaggcctggaagatcatcgaaggtgagggtgatgccccggacgccactgacgaagaccgcacgtggaggcagatcctgcttgccgctgcgatccagggagcgatcttcgccgtagtcaaggcttcggtcgagcgatcgggcgcagtggccatacgtcgtctgggtggagggcggccgggctgaccgaccgatggtgccggcccgcctccccgctctggccggcaccgcccggaccattcagcacccccgtttttcacggaagatggtgactggccatgcccggaacctgcgttcggggcacggccgctctgccacgccccacctcggagcgctaccgcgtggacggacgcttcagtcgatttggccctgggttatgacctgaatttcgttggtcttcgcgttccgcacccggtacaccgcatgcgggccctggtcacgggcctcttcaatccgcccctcctgcagatccggtcgcccgtcgtgataggtgatgaggtcgttctcttcgtgcggcatttttcctccggtgaagcctttgttttctcgcggctgaacgagcctgggccctgatccttctggccgttccaggtccacggatctatgggtccggcccgtgtactcaaggtcggggatactcctgggcctcttgatcgcgcgcgtgctcttccggggtctgccaggaatcctcgcggcgttgtgcgacgggattctgctcggtcggcggtacttcgcggcgcctgcgtcggctgccgtaccagaaggcaccgatcaggaggatgaccagaaccactccggcgaatatgaggaagagtgaggcctggccttcggccgcgagaatttcgatacctgtcatgcgcagcccctacccgcgatgcatggacatacaagcagtcgaacgggtttaaatcgacggtgcgcctgcccggtaccccagcggacggcgtaggcctgtcgcccatcctggccaatccctcgttctgggcgagcatcgcaagcgtgggccggggtaaacgggcgtgggtggccggccgcgccgcccggtactgcgaagtctggaggcgttggtggacgggatcgtgctgctcagggaagaccacaagacggtcgagaggctgttcaagcagttcgagaaggctggcgatgacgctcacgcggagaagcggaagatcgcggacaaggtgatcgacgagctgaccacgcacacctggatcgaggagaagatcttctacccggccgcccgggaggcggcgcccgacaccaaggaccacgtcctggagagcatcgaggagcaccacgtcgtgctgtggatgctgtcggagctcaaggatctggacgcggccgacgagcggttcgacgccaagatgagcgtgctgatggagaacgtccgccaccacgtcgaggaggaggagaaggagtggttccccgacgtccgcaaggccatgggccgtaaccgcctcaccgaactcggcgaacagatggaggcggcgaagaagagggctcctggcgagcccttggcggtcccgagcgccaagcgctgaccgtgggtcgaacggattgttcatgcgggcgagcggggcgacctgcgaggggtgactccgccgaacactggtccagcccgggcaacttccactggagggcgcaggtctggatgagttcgagcgcggcagcgacacggagggccccaggcacgtgggggtccgacccgccgcaggcccgcatggcccggtttgcggcggcggtcacgtcggcgtcgactgccgctgcggctgggtgcggggaggtaagcacggttttccgcccggaggtcttgaggagatgatgagcaaccgactccacgtgcattcagtcctccgtgttgtgaagtggtgcccgccacctgttcggcgttcaccgggcggacggatgcgctcggagcgcgcgagccattagtcccccgccaggcgagcggctcagacagacccggtcagctgatcgccccaatggatgcatcagagcgagcccacaccgttctgcacccccgcgttgaggttgtcgccctaggtattcgcggccgagtcggtgagcggatgcacggccgcatccgagcacaccacctcggtgaacaccaccggcacgccatgacatcgagggcttccacgagcctgcgtgggaggcgctggagaggtccttggcgatcgtcatcggagcgtcgcgatcaccccgatcggcttcggcgggaagatcacattcggatgtttgaaagtgctcggacagtgaagaagctgaactgacaccggctttacaggacgaggtaggaaggcatcatgggcatcattgcttggatcctcatcgggctgctcgcgggcctcattgccaaggcgctcatgccgggcaaggacccgggtggcctcatcatcaccatgctcatcggcatcgcgggcggcctgctcggcggctggctcggcaaggtcatcttcggcgtcgattccatcgacggcttcttcgatctctccacctggatcgccgccatcgtcggctccctcatcctcctcatcctctaccgcctcctcactcgcaacaggcaccgccgtgcctgacccggcgcgttgatcggcccaccacccgccgaaacggctccccctccagcttgagggggagccgtttcccgggctcggcactcgttttccagagctacgcctgtcgggctcgtactcgggcgcacgagactcagtcggcgcggtgggctttgtgcggagtcacccgcagctgtaccttcgcggggaggtgggtctggccggtggactggcgggcgcgttccagcggaccgtcgaccagcgcctggagggcggggccgggggcgctgtcggaggcaagggtgaggtcgaggtgggcttccggatgcttggccgagccgtccatccttgcccgggccttctggacgcctggctgttgtcgggcgtcggcggccagagcgtcgctgagggcgcgctcgcgcagttccacaccgtccacgacgggcagtccgcccagggggatgtggccggggtgcgtgcggcgcagttgcgccagcagccaccagacggcgagcacaacgacgagcgtcaagacggcaatgaccacgggccaccaccatccttcgtccgtccagcgggtgcgatcggcggcgtcgagcaggacgccgtcgggagcggtcaggggccagccgtcgggtggtgtcagccgccagcgccggtacaagtcgaagccacccgccagaatcaggatgccggagccgagcaggacgatgcctgtcagggccagcaggactcggttgatcgcggacttcctcttcatgggatccgtttcctgtctctcgctcgaccgtggtccttcaggggcgagtcacttccggcgtgggcgtacccgaacggcgagccgaggagggcgggcaagggcaagccgggcgagttcctcccgtagagcgaccaagagatcggccttgacatcggccggggcacggaaacgcacgtccgcccgggccccgacgcggttccgggagatccggatcctggcagcactgaccccggggacgtgcatggcggcatcccgcagaaggagtgccgcggcgtcaccgtccagcacggcgtgcgtctgcgcgtcgggggttctgaggggcaactggtcacgcaggccgggggtgagggccatgacgatcagccagaggccgaggaggccgatgacgaccgcgctgatctgcatccaggtgtcatccagcgggcgggtggccagttcgtcggccaggcgcgtgcgccaggctgcggcggtccggccggcatggaccctgatgatgtcgaacaggagggtcccggccgcggccccgatgagcagggcggtcagcgccgcgggtatccggcgtgcggaccacgggcgcctgacggtcggccgtgggccggccgactgctttgccagctgccccacggtgcgggaggtgacctcgtccggtgcggtgggctgctccgtttcggccgggtgggcttggtcccgtttcataccggctctccttcccggtgcgcctgcggaccggttcactgcacgcgtcggtcttccagcccgttggagggaaccaggcgctcgatggcgagggtcacttcagtgacgcgcatcccggtcagacgggcgacccgctcgccgacgtagtgctgcacgtggcgggaggcacgggcgaggtctatcgggtagggcaagtccatagtcagtcccagccgggctgtgccgctcccgacggtgaccgaggcgtgcggagcggccagctccgcatgcgcggctgacgtgtccgtgtgcgtggccagggcctcccgcgcggcgcgggccgcaatgcgggccaccaccttctcagggatcaccgtggcgccacgttcggcagccggtaggaccggccgggttgctgctgctccgccgggcgaatcagcggcaggctgcgaggtcactgccggtcccgggagcgtgtgaagtcggagagctccaggtcaccctgcagcatgcggccgatcaccaggcccaccaggcccaggaacgccacgagcagaaacgcccagaagccgccgaagaatgcggcgaagcccagggccatgccggcaagcaggcccgtggttgctgcgctcatctcactcacctgaatttcacgtcgatcgcgtcttcgcccggcggcggggatgccgtgggctgcgaggggtcactgcacgcggccctcgccctcctcgtcgtccttctcgtcgggcaggtggacgtcggcgacggtgatgttcacttcgacgacctccaggccggtcatgcgttccacggccgtgatgacgctggtgcggacgtcggcggcgatgtccacgatggcaacgccgtactccacgacgacggcgagatcgacggcggcctgccgttcgcccacctcgaccttcacgccgcgggacacgcttggacgtcccccggggaccttgtccgtcacagccccgagcgtgcgggccatgccggagccgaggctgtggatgcccggcacctcgcgggtggccattcctacgatcttttcgacgacgctgtcggcgatggtcgtccggccccgcgtttcgggagccgtcccggcgccggtgtggccctttagcgccttgccggcagggcgcgactcgatcccgcccgccgtggggttgatggtgtccgacatgaggacctccccagggtgtccatccgggcgccggtgcggtgccctcatgctttagacacgccgcaggggcattcctcacccggctggcgtgacacacaccgcataccatcgaggagtgcgtacgcaggccgcggcgaccgtctccggcagaaagcgagcggcggatgcgcaaccggacgagacccccgctcccgcacggcgcagacttctcgctgcggccggcgccgcagccgatcgccgacgtcgccgcggaccgggacactcccggcgacctggacgacagtgccctggcggtacgggcttccgaaggggatgaagaagccttcgccgtgctggtgcgtcggcacggtggccgcctggtcgccctcgcccagcatctgctcggcaaccgggcagacgccgaggacgccgtccaggactccttcctcagcgcctggaggcggctgccggaattccgccacggcgcctcgttcggcacctggatgtaccgcatcgtcacgaaccgctgcctcaacactctgcgtcaccggccctgccctctgcccctggacgtcgtccccgaacccgctgccgcggacgcggacagctcaccgccgctcgtggctgaggcggacgcagcgacggcggccctggcgcgagcgcttatggaactgcgccccgagctgcgcgtgtgctgggtcctgcgggagctgcacggcctgcactacgaagagatcgcccacgtggtgggcaccagcgaacaaacggtgcgcggcagactctttcgcgcacggcgcgctctgatggaggcgatgcgcccatggcgctagacgacccgcacctcacctcccgcgacgagcccgagaacgtgggcgccccgagggccgaggcatcactgatccctgacgcggagctgctggccggcgcggagctgctgccctgtggacgccccctcggccgcgcctgggaagaggcccgggaccccgccgccggtgccgcacacccgcacagcagcagctgcccctactgccaagaggctgccgaagggctgacagccctggaccgggccacccgtgctctacgcgccgaggatcaacccgacagctttagcctcgccaaccgggtcatcaacgcggtccgggccgaggcacgactggggaccatgctctggctggacgatcccgaccacgatctgcgcatcgccgagagcgccgccgccaaggtgctgcgtcgggccgccgacaccgtcctcggcgcccgcgcggccagctgccgcctgacccccgtaccgggcggccactccgtcgccatcacggtggcagccgcgctcgacaagccgctgcgggaacgggccgaaaaggtgcgacaagctgtcctcaacgccgctgagcacaccctcggtctcgccgtcacggccgtcgacctggaaatcaatgccgtgctggaactccacagtgtgccgggtggcgagcggttcgagctgagcgaacgatgaccgccccccaccctgaggacatccagcaggcggtagccgcagcagcccttgctgctcccggtgtcgccgcactccagcccgcgctcgccgacaggctggctctcgcagcctcccgcgccatcacggcaagaaccacctcgcatcacgaggcgtccgggatccgctgcgaacacacctcggaaggcggatggcacgtggaagtgcgctgcatcctgcacgctgaccgtcgcgtcgtcgacatcgcccgacaggttcgcgaggacgtgcggaccgcagtcaccgcctgtctgacccaacacggcacacccaaacccgtcaccgtcctggtgacggtcacccgcaccgtttgaaccgaccgctcgcacgtcctgcctgccgtgcgccaccacgtgagccgtcagctcggcagccgtcaccgcccgacgagccgacgaagcggccgctactcgttttgcgaagcccgctggcgcagagcccctgcgcacggcccctcagcagagcagccccaccgccccgggctcgcagacgcaccccattgcgcggtttgacgtctccgtggggaccggcgtgcactgcggcagcgcgagttcacggggccggggtacgccagtgcgggctgctgcctcaggctgacccgtcctttcgggccttcccccgccgcttctccgcacgggctcgggccacgcggtccgggtcggcgggcgggcccccgcccgggccggttctggacgaagctcctggggggcggccgtgttcgtccaccatggctccctcatcggggagcagtgccgggcgggggttcgggtccttctcgcccatgatccaccgcctttgtcagtcggtcggctcctgtggcttggcgttgcccgggccggcagcgggttgctcgccctcatcgcgcgtgcccttctcgtggctgccgcgccggggtcgtccggccgcggcgtccgggaggtcgggggcggacgggcctgcgggtggaaggtcaggagtgagggcgccgcgcttctccggcacacgatccggaagttcaggctccggcggggcactgtgcatgacaggtctccttacacgtgggctcggaagagcatggggacgactagcggggaggcgcctgctgtccttcttttccgcctgccctgtcctcggcatctcactcgcgcaaagggaggtcgacatgtggcccttagaggtcgtctcgtttggttctccaggcaactgggtgggtgcctgcgactgtcgtggcggcagggttacatgccgcggtctggcccgctccacggctctggccgttcgtcggcggtcatcggaagacggcgcagctgtaccgggccggggtagaaggcggaggtgttggggccggccatgtcttcgcccatgagatagcggtagagccattcggcgaagctcatgtcgtaccgtgcccagccgccttcgccgtcttcggtcaggagccagggggccgtggcgttcgcaacgacgaggaagatcgtctcgcctcggtctgtgcccgcgatcggccacagtccgtcgcgggtgccgaagctcaactccgtgagtccgaaaagcagccgagggtcctcctccgggtcgaggccgtcccaggacacctctgaccaggcgcggaccgtgtcccgtatgtcctggcccagattccagcgttcggtcgcggggtggtgcaggtacaggtggccgttgagctggatgggagcgtatgcgtccacgagggtctggtagtcggtcggcagccggatgccgacttctgcgtggagcttgtcccaggcggcggggtccgcgtagcggttctgggcagggccgagcatcgccatcgcggcggccaggtagtcggtcatggcgttcctcgctggtgtgtgcagtctgtgcagcaggtaagcccctcgattgggggcattcggttacgggatggatcatcccagctcggagggctcgccggtcaggctgtcagcctgcggtagcagatcagggcggcggcgatgccggcgaacgccaggaagtgttcggccttccgctcgtggcgacggtgaggacggcggcatccggacagccaggccaccgtgcgctccacggtccaacggtgacggccaaggcgctgggaggattcgatgacccggcgcgcgatgcgtggtgtgatgttgcgggagcggagccacgcgcgcagccggtcgtagtcgtagcccttgtcgccgtgcagcttggccggtcgccggcggcgcggcccgcggcgggaccggatgggcgggatgccccgcaccagaggctccagaccctggctgtcgtgggtgttcgcagccgagatcccgatggagaggggcagaccggtccgctccgtgatcaagtggatctttgatctcttcttgccgcgatccacaggattcggacccgtcaggtcccccctttgagggcccgcatgttcaccgagtcgatcgcacaccgcgaccagtccagtccgccgcgtgcgccgagctcgtcaaggaccaggcgatggagcttgccccatactcgggcctggctccactcggtgaagcggcggtgcgcggtcggtccggacgggccgaagcccggcggcagttgccgccacgtgcagccggtagtggccacgaacacgatggcagccagcacctgccggtccccataccggcgccgtccccctccctgcggccgcaccggcgccgccggaaccacccgctggaacaactcccacaacccgtttggaaccagacgctccaccatcgtcatcacgagagtcagcttagtgatcaagccagttgagacgatctcttaagcggtttcgccgaagccgcggctgctgggggctgcctggtccgggaagctggctccgttcgtcgtctgcgggcagggcctacaccagctcgtcatgggtcaggtctccctcgacctccgggaccaggcacccgagacgtcctcgtagcgaaggggcacggtgttgatcgcccacttctccctcaagtggcgcagggcagcaagggagctgcccgaaaggctggccggactgctcacaggggtctcacctcggtgctggtcaggacctggggatcggggcgtcaagcgtgctgtcaccgtggttctgccgtgtgggaagactgttccttccgctgcgcggccgctggtgactgctggtccaacgagaggcgcgggtgaccagggaggccgctatgcagggccggctcggaggcggatcggcggatgcctgcaggtcgggggtcaggtgtggaggcggctgttggtgccgtcgtggctgtcggcgtgttcgtcgtcgaaccagtagtcgccggctgcgaggtagcggaaggagtgcgcgctgcgggcgggcagggcgacggtcgcggcgcgggtgccgtcaccgcggggctccagggggtgggcggcggggttccagctcaaggccgacaccagccattcgtgggcggtgccgggggtggggtcgggccgggcgccctgcggggtgttcacctgggccaccagttcccagtagccgtcgatccgcgggtcggccgcgagccgggcggccagcaggccccggaaacccggagtgtcgggggcgccgtacgaggcggcggacgcggtgacgaagcagtcgagagcctccccggcgcgcggcggccggctgcgccgcagcggccagctcgtacgcctcggccagcccgtcgtagagcacctccggccggaagtcggggggaactggtgggccgagggctggcagggcccggtgtcgcccggacaggggcgggtgacgaaggaatgcagctgtgcgaaggccagcagctgcccgggcgccggctccgcgggcggctgcggcaccgccgccgccaggaacgcagagaccgcccccgccggcatccgcagcggcagccacgcccgccagaaccgcgccagcgagtccgtggtcggtggactggtcaccccgccgaccagctgcagcacctcggcccgctcctgcggcgctctctccgcgagcagcttcagccccgcctcgcgccaccgcaacgccgatatctctgtgcccagttcactgagacgatccgcgacggccgcctcgagcactggacccgagatgtcctcgtcctcgacgatcctgtgcacctccgacaccggcagatcgagcgcccgcagcgacctgatcaaccgcaaccggtccaacgccgccgtcccgtaccgccgatgcccccccggaactccgcccggcctccggcaacagcccccggtccgaatagaaccgcaccgtcttcacggtcgtcccggcccactcggcgagctcgccgatgctccacagaccgtcgtgcgaggacaccacttgaacctccaccagggggaggatctagcgcacccgtcagggcggccggatgatcaaggaaatcgaggccgtcggtgcgcttcggcgcgggccccgggcggaggtcccgggggtgacgtacgggggagaaggccatgaccgagttcatcctggtgccgggtgcgttcaccgacgctcacgtctgggaggagaccgcggcgcggctcggggcggcgggcgccggggcgcacgcggtgacactcggcggggaggccggtgcggacctggaggcgcacgtcgcggacgtgctgcgggcgatcgacggtgtggcgccgggcgacgacatcgtgctggtgggccacgactacggcatccaccctgtgctcggcgccgccgaccagcgggccgggcggatcgcgcggatcgtgtacgtggaggcgggtatgccgcaggacggcgtcccggcgctggccgccgtgcccgaccaggtactgcgggacgaactggccgccgggcccggggccggggtcctcgcggcccccgcgttcgacgcggagtggcagcgctggggcagcaccgccggcatccccgccgacgcgctggagcggctgacccgccgggccgtcccgcagccgctcggcacgctcctccagccgctgaggctgaccggtgccgtctacggcgtgccgaccagcggcgtgctctgcaacggcaacggcgcgggcatcgagatgctccagcacttggtgaacatgggccttcccgggctccaggcgctcgccaccccgcaggcctcgttcttcgaactggccaccgggcactggccgatgctctccgtccccgccgagctggcggacaccctgctggcggccgcggcgggggagggccactggctgatccccgcgaccgaggaactcacggtccacctgcggccgttcctgatggacgtgcccgaggggaccgggcacgtggatctgtacgtccccgacggcgcggccggcccccctcccggccgtggtgttcgtgcacggcggcccggtcccggccgacaccgacgtcaccccgcgcgactggccgatgttccccgggtacgcccggctcgcggctgaggcgggcgtggtgggcgtgacgctcgaccgccggccgttcgacctcaccggctacccggactccgccgaggacatcgccgcggcggtggaactggtccgggccgacccgcgggtcgaccccgaccggatcgcgctctggttcttctccggcggcgggccgctcacggccgagtacctcgacgccccgccggcctggctgcgctgcctggcggccgcctacccgatcctggcaccgctgccgaactggggcctcaccggcccccgcttccacccggtggcggcgctggccggcgctggccggcgcgggcgagccgccggtggtgctgaccagggcgggtctggagatggccgaaatcgcggccactgtcgaggagttcctggccgcggccaaggagcacggcacccgtgtcgaggtggtcgacgtcccggacggccaccacggcttcgagaccctcgacccgacggacgcgtcccgcgaggccgtccggcgcgccctggccgccgtactggcccacctggcaccctgagccggcgccgggccgtcccagcgggagaccgggcacaccgcccggggcaattcggggagggatccgggcgggacggcctgcgccgtatgcggcgctggaccgttggtcaccggcagcgaccccatcggccagccctcacccgcggccacatgctcgccgacacggtcgcagaccccgaccggccccggctgaccggcttgactccaggcaccttggaaggcgtcgctgctgtcggtgcggtgggggttgctgaggtcccgggtgccgcgatacggagatccgtcagcgcatggggctgcagggcaggcgaggtggattttggtgctcagtccgccgcgggaccgaccgcggttccgccgctggtcggcggagggaacctgggaccggctcctggcccacgtccagcctcgtagacggtcttccacggcccgtaccagtcaggcggccaaggagtacgtccgcgagatcaacacggccctcgcaccgtaggcggcgtcggcggtcacccaccggaacgggatccggtccatgatcgcgcggtggaagacctcggcggcgagtgggcatgtccggacggtgtggcggtcgggcctcgagcaggttggtcatgagcgaatcagccccacggcaggtcctggatctccgtcacctccaccccccggccgcgcaggtcctcgtacgcctcctcgatgtcggtgacgacgacctgcatgttgtccagcgcccccggggtcatccgggtcagccccttgccgatcgcgatcgagcaggccgagcccggcggggtcagctggacgaagcggatgtcctcgctgacggtgacgtcgtggtcggcgttgaagccgagcttctcgtagaaggcgttggcccggtccacgtcggtgacggggacggcgacgagctccagtttgatgtccgtcacagcatcatgcgcccggcaccggtgcctcaccgtccgacaccgcgaactgggtgcggtacagctcctcgtaccggccccccgccgccagcagcccggtgtgcgtgccccgttccacgatccggccgtcctcgaccaccaggatcaggtccgccgcctgaacggtcgacagccggtgtgcgatcaccactgccgtccggcccgccagggcctcgcccagggcctcctgcaccgcggcctccgaggtggagtccaggtgcgcggtggcctcgtcgaggatcaccacccgctgccgggccagcagcagccgcgcgatcgtcagccgctgccgctccccgcccgagagccggtacccgcgctccccgaccaccgtgtccagcccgtccggcagcgaggcgacgagcccgtccagccgcgcgcgccgcagggcctcccagatctcctcctcggaggcctccgggcgggccagcagcaggttggcccgtaccgactcgtggaagaggtgcccgtcctgggtgaccatgccgagcgtctcgcggatcgagtcggccgtgaggtcccgtacgtcgatcccgccgagccggaccgcgcccgcgtcggcgtcgtacaaccgcggcagcagttgcgcgatggtcgacttgccggcgccggacgagccgaccagggcgatcatctggcccggctccgcccggaaggacacctcgtgcagtacctgcgtaccgccccgggtgtccagggcggcgacctcctccagggaggcgagggagaccttgtcggcggccgggtagccgaaggagacccggtcgaactccacggccaccggaccgtccgccacccggcgggcgtccggcttctgtgcgatgagcggttcgaggtcgaggatctcgaagacccgctcgaagctcaccatcgcgctcatcacctcgacgcgggcgccggccagcgcggtcagcggggcgtacagccgggtcaggagcagggccagggcgacgacggaaccggcgtccagggaaccgcgcagggcgtagaacccgccgagcccgtagacgagcgcgagggccagcgccgagaccagggtgagggccgtgatgaaggccgactgggccatcgccgtacggatgccgatgtcccgcacgcgggccgcccgggccgcgaactccgcggactcgtcggccggcctcccgaagagcttgacgagcgtcgcgccgggggcggagaaccgctcggtcatctgggtgcccatcgcggcgttcagcgcggaggcctcccgctgcatggccgccatccgggcccccatccggcgggccggcaggacgaacaccggcagcagcaccagcgccagcagggtgatctgccaggagatgccgagcatcacggtgagggtcagcagcagggtgacggtgttggcgaccacccccgacagggtgttgctgaacgccctctgggcgccgatcacatcgttgttgagccggctgaccagcgccccggtccgggtccgcgtgaagaaggcgaccggcatccgctgcacgtggtcgaagaccgccgtccgcagatccaggatgagtccctcgccgagggtggcggagagtctgcgggtcagcagtccgagccccgcctccgcgaccgcgatcagcgcgatgagcagggccagccgggtgaccgcggaaccgtcccggccgtccacgatggccgtgacgacccggctggcgagcaccggggtggccaccgcgagcagcgcggtcaccacactcagcagaaggaagagggtgagcccgcggcggtgcgggcgggccaaggcggcgacgcggcgcaggccggcccgggagagcgggcggcggtcctgctgggcgttgatcgcgctgtgcagcgatgtccacgcggtgacttccatgtccatgacccgaacgctaggacctcaaccaaacctgaggtcaagcattcggtccgggatcgcccgcacggtgcgccaactcccgtccgcacgagcgattttgccgacccccgtacgttgtcggtgcccggtggcatcatcggtccatgacgcagggatccgagtccgtacgcttcggcaaacgaaccaccgacaccgtcctgcaccgcttcgagcggtgggcccgggacaccccggcggcccgcgcgctcatcgccggcccggacagcctcacctacgcggaactggacgcgcgcgccgaccggctggcgcgccgtctgctcggctccggcctgccgcccggcgcactcgtcgccgtcggcaccgcccgccagagcgaactgatcgtcgccctcctcgccgtcctcaaggccggcggggcctacgccgtcctcgacgtgcggagcccgcgctccgggcgccggcagctcgccgcggcccagcccctcgtcctgctcaccgatgccgcccagcacgccgccctcgacgacggcggcggcccccgcgtgatccggctcgacgcggaggccgcggcgatcggcggcccgcgcgccgaacagcccgcggaccggctcgcggatccgtccgcgcaaccggcctcggatccgcccgcggaccggcttcccgggtcggccggcgcacagcccggccgcaccgccgcggtgctgttcaccggggcggccgagccgcgcgcggtccccgtgggcaacggactgctcctcgccgcccacgacggctgggccgaggtcgcccggccgaccgcgcaggaccgccacctgttcacggtcggtacggacgtcaccgccttcgccgcgggctggacccgggccctgtgctcgggcggcgccctcgtgctctccccgcgttccggctggcagcccgaggacatccgcgcggccgtcgcgaccgagcgcgtcaccgtgctgcacaccgacccggccggcgccgcccgactgctgatcgaggacgcggaacagcagaccctcaccccggcggcccatcgcggagccgaccccgccgcccgctccctccggctgctggccgtctcgggcgaccggctctacctcgacgagcaggcgaccctgcagatgcggctgcgccccggcgcgcgcgtactcaacgtctacggctccgcggagtgcgcaggcatcggcacctggttcgaactgccgcagctgccccacccgttggacgacccggaacagatctccctgctcggcaccgccttccccggcttccgggccgaggtgcacggcggcgagatccgcctcctcccgccggacggcggtgacgcgataccgaccggcgacctgggccggctccgcgcggacgggctgctggagtacggcggccggatccgggaccgtatcaccctgcccggcggccgatggctcgacccgtatcccgtcgaatccgccatccgcagccacgacggtatcggcgcggtcatcctgaagggggtcgacggcccccgcggtccgcggcggctcgtcgcgtacgtggccccgccgcccggcgggccgaccggagccggccgggtcctgctgccggacatcgaggagctgcgcgaccacctggcgggcaaggtgctcagggaggagtccccgcgcacggtgatccggctgcgcgccctgccccgcaccacaacgggccaggaggaccgggacgccctgccgctgcccatcatgcccgcggcggcggggcgccccggaagcaaggccggcaagtacgggtcggccgcgagccagggagagaccccggcgggctgcgcggccggctgcgggggagtcggactgggcttcgtcgccctgatcctgacgaatctcctctggcccggctcgaccgaactcggcggcgtgccgcagccctgggcgttcctgttcttcctgctctacgtgttcgagtgcgtcgccttcggtatcggggtggtcttcctgttcggcggccgcgcccggatgctgcgccagcggcgcagcccgtccctcaccgtggccgcccatctggcggtgtcctacctgctgttggcctggtggccgcaggacaacctctaccggctggccgccaaacaggactggccgcgtcaggccgcgctcgtctacgccttcaacatccccctgatgatcgcgggcgtcgtcgtcgcggcctacgtcgtcagcaaaccggccgaccccttcgacttccacgaccccgtcgacgactggcccgaccgctgaccggagctctgggctccggccgcagaccgtgaggggccggcatggtttggtccgatcggtcagatctgccggtgggtcgcgccggaaggttcggggaggcgacacagccgaggttatgaatgaaatcggatgacggtttcgtcatccgaccatccatgagcatcaacctcaggagccccacgatgcgccccatcagagcagtctgtctcggtacggccactgcgctggtcacccttctcgcctgcacccctgtcgcggccgccgccacgacggacgccgattccgcccatgacaagggcaaggagcgggtcatcaccctgatcggccggctcgcggagcagacgcgcttccccgtcaaccccggcggcgccgccgcccagggcgaccggaccgccttccgctcgaacctcttcgacgaggccggcaaccaggtcggcgagaccggcggcacctgcaccaccacccgggtcgacaacggcggagcggagcagtgcgtcgtgacgtacaccctcccgggcggccagctttccgtgcaggggatggtcttcggcaatctggtcccgggcccgcccccctcgttcgacaacggaatcaccggcggcaccggggaattcgaccgggctcgcggctcggtccacgccgacacgatcggcacgggcacgcggcgcttcacgatccacctcaagcactgaccggccccgtccccgcccggtgagaaggccggccgtccacgaccggcggcaggcgcccgggcatgaagatcacgagctgcggccggaggaccggggcgggccgaacatcgcccccaccgccagggcctcggcccgtaccagcgcctcggccgcgtccagcaccttcctgctgtgcgcggccaccagcactccgagccaggggaccggttcgaaggcaccggtcgggatcgcgggcacgaacaccgccccgagctccgcgcagccccgggccagagccgtgcacaactcgtcgagctgcgcctcgggcagccgcgcgcccagctccacccggtcggcgatccgtacgaggtgccccgcgccccggagcgcgtcgagccgggccgccaccatgaaggcgatcgacggtccggtcagcctcaggttcgtctcggtcggcgcgagccgcccctccccgtcggcgacgaagtccacgtcgaaccagccccggtagccggaatccgccagtgcccggcccaccgccgtcccgaaggagaccagggctttctccgcccacgcgggcaccaccccggggcccaccgtggcgccccggtagcagccgtccgccacgtccatcaccgccccgcccacctcgtgcgcgcggcccgcgtcgtccacgaaaccgtcgtacgtcagatcccgcgggccctcgccggccccggacaccggcccaccgacgtactcctccaccagcagcggcccgcgcggcagccgccgcagcacggcccgcgccccgcccgcggcgcggacccgttcgggcgtgaccaccgtggtgcccgaaccccccacaccgtgctccgatttcagaacggtgctctcgccggccctcgtccgggccgccagcatccgggccgccgcccaccgcccgccggcccgccactgccgggggagcacgatcccgggatgcccgccgtccgccaggatccgcccgaagagctcgtgcgccgccgacttcgactcgtagcgcagctccccgggctgccacggccggcccgccagccgcccgaacggccgggtgcgcccccacgggacgaggggcagcccggccccggtgacctgagcggccagcgccggccgggcccgtaccgcgtcggcgaggccgggatccgtgtccagcaggccgtcgtacacctcgaccccggtccagctcagttggcggcagaccagctcggtccagccccgtggcaccggccgcggcagcaccagcgcggccgggtagggactgtagaaggcggccaggcaggcgtagtggtgcgcgggccgctgctcccggtccaaggtggcgtccgcgaactgcgcgttgaactcgccgacgttgcccaggtgcacggcccgcccgccaccggtccaggcccgcgcccagtcggcgagcgggacgggagccgcctcgaaccgcaccagggccacggcgtcgcctcccccgcccggtgcggtcaccgccaccgcccccatcgcccggtagaacccggccgcgtgcggatcggagtcgatcaccagccgtcgggcccccagctccaccgcccgccgcagcacgtcccggtacagcagccggcccacgccctgcccgagggccgacggctccacgaagagcatcccgagctccgcccgcggcgcggtcccctccagcgaggcgaccccgagcacctctccccgctcgttctcggccacgacgatacggcgggccgtcacgtcgtcggaccggatccggagctcctgcgcgcacgcggccatgaagacggcgtcgtacccccagtgcgccttggaacgcatcaccagcccggtcaggtcctccgcctcggccggccgcgcggccctgacctttaccatctgctgacctccccatggtccgggtcaaggccgtgcgatagattcggcctccccacggcacatactttcccacccacgcggagacaggcttctcaatgagcgacatcatcaacggacttggccgcaccagcgcctacggcgccctcggcctggtcctgctgatcctcggcatcgtcctcgtggacgtgctgacgcccgggaagctcccccagcagatctgggaggagcgcaaccgcaacgcggcgctcttcctcagctcggcgctcctcggcatcggcggcatcgtcttcacctcgatctggacgacgtactccgacttcggcaagggcctgctgtccaccgcggccttcggtgtgctcggcctgatcctgatggcggtcgccttcctggtgctcgacctggtgaccccgggcaagctcggcgccatcgtcgtcgacccgcagccccacccggcggtctgggtctcggccgcctgcaacctctccgtggccgcgatcgtcgccgcctcgatcgcctgacgcggagcgcccgtacggaacgagagcgccgctcccgccggggagcggcgctctcgtgcgtgggcctcggcccgtagtgttcaggcgaggcccagcgcgaagaccgcgaaccccgccgccagcagcccggccacggtccggcgcagcgtgcccgcccggcgtccctcccggggcggcccctcgaaccgccgggcgtagcgggcgagagcgacgaacagtgccgcgaacaccggcatccaggccagccgtgccgcgatccagccgaggctgtccggcgccgtcgtcagcccggtcagttcacccgcgaacgagccgggcacggccgcggccagcatcgccgtctggtgccagcacaggatcgtcatcgcggacaggttgatcacgaccaccggggcccacagagcgggccgcgccagcagtttcaccagccggtcgcgcagcaggaccgccgcccccgactgggccgaggccagggccagtaccaggagcgacggcgggtgcgagttggtgcgggccgcacccggtacgcccaccatcgacgccggatagtggaacaccgccagcagcgcggcgaacagcagcgttccgcccgccagcagcagccaggccccgctccgcccgatccgccgctcggcccaggagacgcccagctggtacgcgaacagccagcccggcgcgatgttcagcagggcgagccacgcgggtacggcgtcggcgaacggcccgtagcgcaggaagtccacgacggcgacggaaccgagcagcggtgcggccgcccagcccccgaggtgccgcgccgcccgcacgcagtacggggtcagcgcggtgaccaccacgtacaccccgacgaaccacagcggttggaccaccagcgtcgccccggtccgcagcgtcgcctccggcacgccggccgcgtacagcaggggcgcggccagcgcccacaccgcggtcaccccgagcaccggccgccccaggcgcacgatgcggcccttgagccaggcgccggtcgtgcccgtgcggcgccggaaggagagcgtcgaggcgtacccgccgacgaggaagaagacgcccagcatctgcagcacccagctcgccggggccagcccgccgaaggcggccagcgggctggcgttgtgcaggccgccgtcggggtcgagggtgaagccgccgagcagccagtggccggtgggtacggccagcagtgccagggctcgcagcccgtcgatcgcgcggtcgcggtgggcgggggtctgccggtcgatccgggcggcggcctcgcgcagcggggccagggtggcggaggcgctcatcgggccgctccgttcgcgatggcggcgaaggccgcgagggactgggtgccgggcatgaagtagccggtgtggccctgtacgtcggccgcgggcacccggcgggcgccgaaggcctcggagacggggtcggcgccgtggccgatcccggcgaactcgacgttcgggacgtcggctatccagtcggaggggccccgggcggcccagacgcgggccccggtgcgcagggctgccgcggtttcggcgcgcatcccgggcgagccgaaggccacgatgtcggaggcgtcggtgtgccgggccgcgagcccgcacaccaccgagccgtagctgtggcagaacagcaccgggtcgggggcgccgaccgcgtcgagtccggcggtgaaccgggcgagccgggccgccccggcccgcgcgaggcggccgtcggccgcgtccaggccgaccccgaccggggtggtgtaaccgatccacgcgacgacggcgacgggcccaccggtcggggtccccttcccggtcgcgggggctgttccggccgcctcgcgcagggcccgggccatcccggccgggccggtgtagggcttgcgcggggcgtcgtaggtggcggcgtcgttgtccgagcccggcacgatcaccgcgacgtgctccgcacgctccaggtccccgaacacctcggccacctgaccccggccgcgcgggtcgaaggccaggatctgccggtccggcgcggcgagggaggcgtaccgcgcctcacccgtggcggccagggcgatccggttggcctcgtaccgcagggggagcggagctccctccaggttgcccacgaccagcgggtgggaccgcagcagccgccgtcgcgccgtgtcgtccagcccagcgaagaaggcggccacctcgcgcggcgccgcggtcgccggatcgggcagcgagcggccggacaccgtatcggcccgccaggcggcggcgcccggcggcggtccggtgaccgccgcctggctgtcgcccgaggcccacccggcggtccccccgacgagggtcaccgccagtgcggccgtgaccagcgtccttccgaagcggcgcatgccccttctcctctcctcgtgacgaggtggaaggtaggtagggggtaccggctcgtacgtccgaccgtggagccaagtcggatgtcataccccggtagggggtggaggagacggcgcccgcccgccccggcgttgctccatgggtgcggtccgcgtcagccgtctgccccagccggtccgtgtgtcggcgtcaccgtcacccagtccccgactagttatggcgatagtccgactaatcgcggcaaagggagtacagacgatgccccaccgggaacaccagcgtgcggccgagcagggacaccgcccgcgccgggtggccgccaccggcctcgcctgcgccctggccgccggatccctcgtcctcctcgggaccgggaacgccggcgcacgggcggtgacctgcttcggggtacccgccaccctcgtcgtcgccacccccggcgcgaccaccgacggaacccccggcaacgacgtgatcgtcggcactccgggtgcggacaccatccacggccagggcggcgacgacctgatctgcgggctggcgggcgacgacgtcctcgtcggcggactcggcaacgaccagatcgacggctccgcgggcgccgaccagctgcgcggcgacagcttcagcccgaccggcgacgccacgggcggcggcgacgaccgcctcctcggaggcgacggggacgaccagttcaccggcgacagctatgcccccgcgggcagggccgaaggcggcgggaacgaccagctcatcggcggccccggcaacgaccggctgacgggggacagccgagggctgagcgcggtcggcggcggagccgaccggatcgacggcggccccggcgacgacgcgatgctcggcgattccggcgcgttcgcgggcgacgccacgggtgccgggagcgacgtactcctcggcgggcccggcgccgagaccatgaccggggacagcgaggccgcgcggaacgccatcggcagcggcggcgacgacctgctcgacctgggccccgacggcggcatctccgcgatcggcgaccacaccgtcaccagcccggcgggcgggcgcgcgaccggcgccgggaacgaccggatcatcggcggcgccgccgacgagttcctcgtcggcgacagcggaccggccgacgcccgccggaccgccgccggcaacgacaccatcagcggcggcgccgggaacgaccgcatcttcggcgacaacgtcgacctcaccggcacggcgagcgcgggaaccgagggaggcgccgacttcctcgacggcggcgacggcatcgacaccctcgcggcgggcccggccggcgacttcctcaccggcggccccgccggcccggacggcccggacgtctgcgacggcgagggcggaaccgacttcgccaccgcctgcgagaccacggccgacctgccctagggggtgtctggccgaccagggcggatctggcaccggccaccgcgagcccgccctgatcggcaagccctcccaaggccccgcggcctcagccggagtcgcccggccgtaccagccccgcctcgtacgcgaagatcacggcctgcgcccggtcccgcaggtccagcttggccagcacccgcccgatgtgcgtcttcaccgtctgctccgccagcaccagatgccccgcgatctcctggttcgacagcccgcgcgcgatgagctccagcacctcggtctcgcgcggggtgagccccttcaaccgcagggcggggtccttgcgcggtgcagggcgctgctggacgaagtccgcgatcagccgacgcgtcaccgagggagccagcagcgcctcgcccgaggccacgacccggaccgccgcgatcagatcggccggcggggcgtccttgagcaggaacccggaggctccggcgcgcagcgcctcgtacacgtagtcgtcgatgtcgaaggtggtcagcatcagcaccttcggacggtgcaccaccccgggcgggggatcgaggatctcccgggcggccgtgagcccgtccatctcaggcatccgcacatccatcagcaccacatcggggtgcgtggagcgggacacctgaaccccctgtcgaccgtcgggggcctcgcccaccacatcgatgtcggcctgcgccgacagcagcgcggcgaacccggcccgcaccatggcctggtcgtcgacgatgatcacgcggatggtcaactcaagtcctcggtcggatcgttcaggggcagccgggcggcgacccggaagccgccgtcgggcagcggacccgtgtcgagcgtcccgccggtcaaccgtacgcgctcgcgcatccccaccagaccgtgccccgttcccgaactctccagctccaccaccgcgtcccgcgccggaccgttgaccacgaggacgaggacctcgtcctcgtccaccgtcaccgagacccgggtgggcgcgccgggcgcgtgccgcaccacattggccagagcctcctgcacgatccggtacgccgacaggtccaccgccggcggcgccgaccccgccgcgccggccgccagcgacaactccaccggctgcccggcccgtacggtcgcctccaccagctgctggagccggtcgatgcccggctgcggggcccgctcgccgtcggccccctccgccccgcccgcaccgtcgccgcgcagcacggtcagcagcctccgcatctcgcccagcgactcccgcgcgctcgccgcgatcgccgcgaactcctcccgtaccggctccgacatacccggcacccggtacggcgccgaatcggcctgcacggtgatcaccgacatgtggtgggccaccacgtcgtgcaactcccgtgcgatccgggcccgttcctccagcagggtccgccgggaccgctccgcctcgctgatgctctcctgctcggcgacccgctgctgcgcgtcaccgagcccccgcagggcgcccgtcaggaccagcacgaccccgctcagtacgaacagcagggccgtggtgttcatcacgcccgcgggctgcgagaagcccagcaccgtaccgacgacgccggtcaccagccagaccccgaccagcgtccggacggactcgcgcagacccaggcaggccatcagcaccaggtagccgacgatggtcatcggcggccacggccaggagtgcccggcgaccttgtcggcaccgatcaggagcaccgcggccacggtgtcggcggccaggaccacgacccaggcctgcaggggccgggtcaccgcgaggagcagcggcacggtctgcgccacgcccagcgcgcccgcccagccgccgcccgccccgtagtcgttggacagcaccgcgatcgtcaccggcagcagggtgacgacgaagatgcccacgacgacgaacggcgtcgcccgctgccaccgcttgggcgcctgcgcgaacaggggctgctgcgccccggcgggcgtgcgcagtacgacggcgagccgcgccagcgcgccgggcacccgggaaccggccgacggcgaggtacgggtgcgttcgcgggtccggccgcgcggccgggtgcggggttcgtcattcatgatcggtccagcctatgcgccgccgtggcccgagtgggggagagctaggctgctcgcctgtcgatcatgggggacacgggaatgggtggcgcggccgcgttggaaaaactggtgccggtgctgctggcattcggcggcggggtgctgctcgcccgccggaagatcgttccggccgaggcctccaaggtcttctccgactacgccttcctcttcgccgtcccctgttacctcttcggcaacatctacgccagcgacctcggggccctgttcaactggcgggcgatcggcggctacgccggggccgccgccctcgccgtggtggcggtcgccgtggccgcggtcgcccacggcctgcgcgagccccgcgacgtggcgctgcgcgtgatggcgggagtccaggtgaacaccgcctacttcgcggtccctgtcttcatcaccgtcttcgggacggcggcgccgatcttcccgatcctgctgttccaggtctgcgtcctgtccctggtcgtcatcgccctcatggaactgggccgcgcgggtccggaggccggcggcccgggccgccgcctctcccgggcggtcggcgcctcgctcgcgaccccgctggtcctcgcctgcaacgcggggatcctgctcaacctgctctcggtccggatcccggccgtcgtgctggacggcgccgcgttcgtcggggacagcgcctccccggtggccctgttcgccctcggcctccacctcggcggcctcggcctcgacctgcggggcaccacgcgcgaggaactcgccctcatcgccttcaagtgcctggcgttcccgctgctgacctgggcggtgtgcgggctgctcttcggcgtgcggggcgagtggctggcgtacctcgtcctgatcgcggcgatgccgaccccgcagaacctgttcatcttcgcccagcgctacgacgtcggcgtcgacctgtccgcgtcgatcgtgatcaagagctcgctggtgtcgctcctgctgctgcccctgtggctgcagaccgtcgcggcgtgaaccgcccggcgccggctcgtacgtaccccgggcgccgtcggctcgttgacccggcatggaactgccgaccatcgcggcgccgggcgtcggggaacgggccgacgccgtggccgatgccgcctgccacctctacgacaccgtcgctccgtggggaaccggcgcgcccggaggatggagccggaccgccgccgaggacgccgccgaggcgatcgagaccaccgcgcacgccctcgcgtccgccggaccgggggccgaggtggtcctcgcgcccgtccacgcggccctcgccgacctgcgccgccggctcggcctcgcgcccgccgacgcgctgaccggcgacgggctcccggcgaccccgcgtacggtcggcaatccgcgccggacccggtgggtgcgggtgctcaccgccgcgccttcgccccggcaaccgccttctcgtacaacttcctgatgtccgcgccgaagtaggagctgtacgaggtgtcggcctggtccccgccggtcttccagccgccgatgacccccaccacgtcaccggtcccggtgcgggcgtcgtagcgggtcaggaacggaccgccgctggtcccgccgggatagccggtgcagttgatgcgcgggaacgatcctgggatccgcgcgtcgccactggtgaacttggtcgtccggttgacgcacacgcgcggccgggcggcggaggccgggtaaccgatcagagtgacccgtgcgtgggcgtaaccggcgccggtcacgagccggttcccgccgaccacggcctccaccgggaagccgcgggcatccggacccacctgggcgaaggccacgtcgagggcggccgcgcggtcgggtccctgggagcggtagcgcgggtcgatccagatcttggagcgcccgcccgcgtcccgcaggaccgggaacatgccgtagggctgcggcttcgcccgcgtgtactgcggtacgaaggccacctgctgcgtgtcggagccgagcaggcagtgccccgcgctgatcaccaggttgcggccgggggaggagaccacgctcgcggtgcagaagtacgccccgccgcccttgacgaggaacatccggccggcgaccgggacgccgtcgaagttctgcccgacgccgggggagagtgcgggcagctgcggaaccaccgggcgggccggcgccggaagcggggcgggagacggaggagacggcgcgcgggtgggcgtggcgacgggggccggggcgggcgtggtgacgggagcgggggtgggcacgggcgtggcaacgggcacgggtgtggcggcggccggggtcgcggacggccccggcggctccgtcgccacggggggcggcggagcgagcggtacctccacgcccggttcggccggcgcgggttccaccggttcggccggcgcgggttccacgggttcgggcggctcgggttccacgagctggggcggcaccggcggcaacggggccgcggaagccatccgttcggcggtccagaaggactgcgcctcacgcgccgaccagcggccgacggccaccggggcggcgacgctcccggcctcggccaggggcagcggccctcccgccaccagcagggcggccgccaccgcggccatcgtcaacgtacgtcgcatgccggacactcctaaacggcctgggggaaacggaagagccggtccgggtcgtaggcacgccggacctcctgaaggcgcgcgaggttcgggccgtagtaggcctcgcgccagccggtgagcttcgggtcggtgtagttctgataggcgcggccgctcgcccaggggcgcaggtcctgccagagcccgtcgagccagccctggtgccgggccacctcggcggccggtgccgacccgggccagtagacgaggtactgggcgaggaaggcgctgtcgcggtggacgaaggcggtggcgtcggccgcgacccggttcagcgcgccgccgcagaccccgtcgaactggaccactcccaggccgccccggggcacgctcgtcccgtaccgccgcacggcgtccaggaccgcgccgatcgccgcgtccggcagtccgccgcccgcccagaagtcggaccgtgcggcgtacgagtcccggccgagccgtccttgcgggtcccggccgggcaggacgcccggcagccggcattgcgcggggctcagctccaggcagccggacatggcccggacggtgtcctcgtggccgcgtacggtgatccagctgtcccgcggcgccccgccgaccaggtcggacagccgggccaactgccgttccagctcccggcgcccgtcgaggcagaccactcgcaccgccggtgacgccccggccccggcgaccgcctcgacggtgaattccacctggctccagaacgggtccggcagcccggccagccagcgctgccagccgcgcagcacggccgcggagtcgtcgccgggccagtggagttcggcgagggcacacgtgccgaccgggtgcgtacggaagcggaactcggtgaccacgccgaagttgccgccgcccccgccacgcagcgcccagaagagctccggatcgcggccggcgtccgcggagacctcgcggacgatcccgtcgggggtgaccacccggacgccggtgagccggtcggcggtggtcccgtacgcccgcgaggccaggcccaggccaccgccgagggcgagcccggcgacgccgacggaggggcacagacccgtcgggacggaccggccgcgcccggcgagagccgtgtggacgtccccgagccgggcccccgcgccgacccggacaccgtccccgtcgaccgagacggcggccatggctccggtgtcgacgaccaggcctgcggagcgggtggaccagccggcgtagctgtgcccgccgccgcgcggcaccacgggcacggcggagcggcgggcgaagtccaggcagacggccacgtcgccggcgtgcgcgggatacgccaccgcggccggggcgacggcgtcgtaccggggctggaacagccggcgggcctccgcgtagtcccgatccgcggggagcaccacgcgcccgtcgatcccgcgcgccagcgcaccgtagcccggggtccgggccgccgccccgacggtggcgaggacggctgcggccgcactgccgaggacttggcggcgatcgaggctcatacctccttcctgccaccgcccggcgcgatagccgtgcaggcgggtcccacgcgcaccggggtgccccctgaacggcgcacagcggaaacggttccattggtcggacagtcataccggaaatcgctcggggaccggcgaacggccgccgtacgctgcccccatggctctcgtggatctcagtacgcacgccgacgcgttcaacgccgacccgtatccgttctacgacgcactgcgcaccgccggccccgtccaccggctggtgctcggcggcgaacgcacctggctcgtcgtcggccacgaggaggcccggcaggccctgacccatccggggctgtcgaagaactggttcggctccgaaccgttcgcgaacggcacccccgtccaggccgtcgccaccagcatgctggactcggatccgccccgtcacacccggctgcgccgcctggtggcccgcgcgttcacggcccgccgcgtggagtccctgcgtccgcgcgtccagcagatcaccgacgagctgctcgacgcgatggcggcccggcccgaccgcagggccgacctgatcgccgccttcgccgcaccgctgccgatgaccgtcatctgcgaactgctcggcgtccccggcctggaccggcagcgcttccggtcctggtcgggcgagatcgtcgccccgctcaacggcgtcggcgcggacccccgggcggtggaggagatgaccgcgtacctcctcgaactcgtcgccgccaaggccgaggatcccggcgaggacctcctcagcgccctgatccggacccgcgacgaggacggcggccggctctcccctgacgagctgatcgggatggccttcctgctgctggtcgcgggccacgagaccaccgtcaacctgatcggcaacggcgtacgggccctgctcgcgcaccccgaccagctcgcggcactgcgcgccgacccggacgccctgatcgacggggcggtggaggagatgctccgctacgacggcccggtgcagcacgccacgtaccgcttcgccgccacggacctggagctgggcggcgtcagcatcgaggccggctcctccgtcctggtcgccctcgccgcggcggaccgcgatccggcgcgcttcgcgcaccccgggccggacgtcttcgacatccgccgcaccggcccgggccacctcgccttcggccacggcatccacttctgcctcggcgccccgctcgcccgcatggaggcacgcatcgcggtccgggccctgctggaccgcttccccgacctcgccgaagccccggacgcgggcccgcccgactggctcccgggcagtctgatgcgcggcgtgacccggctaccgctgcagtggtgagcccggggctctcggccgtgtccgcaaagtcccgcctgccccgcggcgtctggcaccgcacctcgctgcgttgtcgggcacgtccgagtacgtccagtacacggacggccctccgccttgcgatgcacggcgccagacgccgcgtggcccgcccttcgggcggccggcgctactttgcggacacggcctaggcgtgtcaggccgcgagctccagcagccggtggcccggctcgctgccccgctggggcgggtccaccgccagttgccagaacgatccggctcccgcgggcgcggggcagccgtcgggcgtggagtgcggggcggacacggtgaccgtgccgaccagcgccccgccccgcgtcgcgccccggcactcgcccctgctcagccggtggcgggtgtcccggggcgactggtaggaggcgaagaagacccgcccggcggcggcgtggtccgcgtaggcccggtggagcagggcggtcggctcctccaccgagtcgccgtcctggaaaccccgcaggccgaagccgcccgcccccgcccccggctccgcatcccgtccaggcccggggccgggtcccggtcccgctgccgtcgcgtcgtcgatgctcatggcggcggtcaacagcacacacggagcggcccccggcgacgggtctccggcggactacgacgtgcgcgccagcaggaagccgtgacgcgacttctcgtcggggcccgcctcccggaccagccgggccacctccgccagtccggccccggccagcaggccggcgatcagctcgggcggtgtccggtacacgtcgaggtcgaccgcgtgcccgtacgcgtggtcgagccggaacagctcgtcgcccgccatgaaggcgatcagcaggtggccgcccggcgccaggacccgggcgaactccgcaaacagcgcgggcagctccgagggaggtgtgtgcacggtggagtaccaggccagcaccccgccgaggaccccgtcggccacgtccagggtcgccatcgaccccacttcgaaccgcagccccggatacgtccggcgggccaccgccaccatcgccggggacaggtcgacgccgaaggcccttacgccgagcccgttcagatgcgccgtcacccggcccgggccgcagcccaggtcggccaccgcccggcccccgccgcccgagtcctcgcgcacgtattcggcgaaggccgccaacatggcgcgatccagcggctttccgtccagttccgtgctgaacagccgcgcgtagtcgacggcgacggcgtcgtaggacgcccgtacggagctgaggtacgaggtctctgtcatgcccctgaacagtagtgtccgaagcccctccgaggggaaaccggccgagtgctcccgctcaccccccgaccagcggattgggcaattccgcccactgatcgcccggaaccccgggactcagccgcatcagggtgagcgccttggtgggcagcggcgcggtcagcagcgccgcggtgtccgcggtggccggcagggcggccgcctccgcgagcgcctcggcgaaggccccggccgagcccgccgtggccccgagcgcccccgtcagcagggacccgaacagcttgcgccgcagcacgctcacgtcgtccgtgaccagcctgccggacaggggcggcaccggcaggccgtgccgggccagccgggccgggctgatccggatgtcagccaggtcgcggtagaccagccgcagcggggcgccggtggcggagagcacgaccaggaggttctgaccgtgggcctccagtgccaccccgagctccagcacccgcaggcacaccgagagcgcgagccgcgcgaacccggcccgccaggccgccgaacgcgccggcccgaaggaggccagggccgccaccggcagcacccgctccccggcggcggtgtccgcgtacacctcgggcggctcgcgcagcaccgccgccaggtccggactgtgcgcggtcgtggcgcccagcgtacgggtgatgtgcagccggccgtcgagccgctcggacaggccctgggcgaaggccgacacggccgccgccgtctcgatggagtagaccgagatgtcccgcacggacgaggtcagccgggcgctcagcgcggtcttcacgtgcgccccgccgtcgacgggggccagggtgcgcagggccatcagcggatgcgccgcgaaaccgggccgcacccgctcgtgcttcaggacgtgcgccgcctgccacgggtgcaccgggaccaggatccgccccgcgtcccgcagcccctccggccagtcgccggtcaccaggcactcctcagcccgcacggcgaccagcccgagctccaccaccgggcggtgctcgggcgcgtacgccagctgctcggccaccgagaaaccgggccgggaacggcagttcgggtggtagggatgcccgtcgaccacccgctgctcccactcccaggtggtccgcggggcccggtcctccccggtgggcggctgaccggcccgggagagcgcgagggaggccgtaccggcgtccagctcggcggcgaactgctccccgtgcggcacgccgagggccgtcaccagccgcgcggcctgccggtagggcctgccgtcgagcagcagctcgctcacgtacgcgtcggtcgcgtacggatccggcagcgggccctccagtctggcgcccccggccagcagcagggccaggccgccgggcgcgtgctcacggcccacgacccagggcagcggttcgaaggccagggcccgccacagccgggtcagcacggccgcccgggccccgtcgagcgcggcgccgtacgagggcccgagtgacgggcgtacgtcggccagttcggcggcgaaggcctcttcggccggggagggggaaggatgcatgctgaggctccggcatcggaatatcgcttttcgggatgatcaagtaatgattgcggatactgaagatcacggctggtggttgcgccctgcgaacctccggcgcaccggatggaccgaatggaaccagtggacctcaacgccgccgccgacgcgtacgccgccgcccccctcctgaactgcctgctcagagaggcggccgaacccgccgaggggcacgacgcgggcacggcggaagacgtacgcgtccaccggctgcgcggcagcgggcggctgctccgggtgcgcggcgggcgccggccccaacgccccgagctgcgcacggcacacggctggcacccgctcagccacaccgaactggccaaactcgtctccgacgaactgggccggtacaccggcgtccccaacgacgagctccccgtcgagatcaccgacagccgcgacgcgatcgccgcgctgctggccgcgcgcgccgtcgccgagcccccggcggacccgtacctcctctccgagcagtccctggtgatgggccacccgcaccaccccgcccccaaagcccgcggcggggcgccggccgggagctggctgccgtacgcgcccgaggcccacgcccggttcccgctggtcttcctggggctgcgcgaggaccagagcaccgaggagggcggcccggccgcctccgccgcgatcgacgccctcgccgacctcctcgacgggccgcgcccgcccgccggataccggctgctgcccgcccacccctggcagctcgacctggtcggcgaggggcccgcggtgcgcgaggccttcgccgacgggcggctggtgcggctcggcgcgagccggcggccggcctggccgaccgcctcgatccggaccctgtacgtaccggacccggcggccgacctcttcgtgaagttcagcctcgacgtccggatcaccaacgacgtgcgccgcctgtggcgccacgacctgctgaagctgcgccgcaccgacgcggccgtcgaggccggcttcgccgccctgcgccggaccggctcggccgccgcctggctccccgaccgcggctaccgcaccgccgccttcgccttcgaggagctcgccgtcctggtccgggacggcctgcacgcgcacaccgtccccggggccacgccgctgctggccgccgcgctcgccgagggctaccccgggaaccccccggccgggaccacggacccgctccactggtggcgggcgtacctgcgccaggtggtgccgcccgtgctggaactgttcgcccggcacggcatcgtcctggaggcccacctccagaacacgctggtcgccgtcgacgcggacggcatgccggtgcaggccctcttccgggacgcggagggagtcaaactggcggcggacctgccgcgggcggacgcgtggcagcgcctggtctactgcctggtcgtcaacaacctgacggagatcgcgggggcactggccggacggcatccggacctcgctgcgcacctgtggccggccgcccgcgaggagttcctgcgctacgaggcgacccgcgggctccccgagatcgcggatctgctcgccgccccgaccctgccgggcaagaccaacctgctgctgcgctggacccgcgcggacggcgcggacgcccgctacctccccctgccgaacccactgcgcggacaacactcgtaggccgtctctttcggaccttgccaggccaagatccgaaagagacggcctgggccgtgcccgcgtcagcgggtgctgctgatcaggacggccagtaccacgcagcaaagggtcagggtgccgccgaaggcgatgccgccgcgagcgagtgccgtggggagcgaggcaccgtcccaccgggtgagcgagacggccatcagcgcgacgatcaaggagagcagtacggcggtcgcaaggcagaccaggactgtggggctgacggtcacgagggcacctcgatcgtgcggcaggaggagtcgggcagcgggatcgaggatctccatgcggaagggcggcgggaagcgattggatgttgtccgccgcacaacgcggggttgtccggcgcacaacgtcggcgagggggccgggtgggcacggggaaacggccggggcgcccctgggcgccggcacggggcgcgaaccaggagacgaacgacctggtgggcatggtccggggctggctcgacgacgctacggtctcggtggcacagctgcaccggctgctgaccccggagcacttcatggcgggcagggttcccgcattgcgcaaactgcgtgagcagctggccggcgagagcctgcagtgggacctggtcgaggcggtggccgacctctgcctcacgtccgggaaggccaccgccgacacggaagacctcgacctggcccggcggctgtggcgccaggccaacgaggcgcccacgcccgtcggcagtgcgaacccggacaccgttcccgcccgcgcgctgctggaagcccaggagcgcacgatccgcgcgtacgaggacatggaccgggcccggcgcgcctacatcaacagcgagcagggcaggcagcaggccctgcagatcgcggtctacctgttcgggatgctggggcaggccaacgcgaagaccgccgagctgaggcgtcgcgtcgacgccctgcaggccggcccacaaggacgcggagaactcgattcggcccgccgccgtctggcgagggccgaagagcaggagacgaggctacgcggtgagctggcccgagcccagcaggaacgggacaccgcgcagcaggtcgccgacctcgctgcccggcgcgtcaccgatctggaaggccggctccaacgcctcgcgcaggcccacccgctggggatcaccccgaacggggagactctcgacatgcacctgcccgtacccacggcctcggcccccgaccgcgaactggacgaggtggacgaggcgctccaccgggtcggtgcggccctcgaccgtgaacacgaaaccatcctggacgcggccgacgagctcggctggcgtgcacgggtgccgggcaccctccagggcgaactggtccgcaccgacagcgcagccgctggtgggacggcattgttcggcacaaccccggacaactcgtccgccggcgacgacgagccggcccagggccggatcggccaccaacgggcacaagaccgtctgcggttcctgggagccgccagcacacagatcgcccgcggcatggacgtggacgagatcgtggtgggactgtgccgggccactgtgccgaccttcgccgacgcgatcctcgtctacatgggtgacccgctgcccgtcggagacgaacgtcgcgagggccccgccgtcttccggctgctccgccgcgaccagctccgcccactggaccagatccccgccgaaccgacgggcccccaccgagcgggcacgaacgacaagcacgtgcgcagcagcctcctccgaggcccgcacggcggtctgagcatccccgaactctgcacggtcgccctggacgggcccctggcagacctgttacggcaggtacgcccggccgtcggatcggctccgggcgcagcggcggccctccatgaactgctcgccgtcgacaccgacgcgctggccgacgaatgggtactcatcgcgccgttacgcggacgccggaggatcatcggagtcgccgttctcctccgcgacgccgatcgtcccgccttcaccccggaagacctcgtcatcgcggcccagctggccagccagaccgctctgggcctcgacaaggcggtcctgtacgggcgtgaggcgtacatcgccgacgagctgcagcgcacgatgctgcccgccggcctgccccagcccaccggggtccggctggcctcgcgctatctgcccgctgccgaggccgcgcgggtcggcggcgactggtacgacgccatccccctgcccggcagcagagtcgccctcgtgatcggcgatgtcatgggccactcgatcacatcggccgcgatcatgggtcagctgcagaccaccgcccggatcctcctccagctcgacctgccgcccgccgaggttctgcaccacctggacgaacaggcccagcggcttggcgccgaccggatagccacctgcctgtacgccgtctacgacccggtcgcgcaccggatcaccgtcgccaacgccggccatccgccgccgatcctgctgcactccgacggccgtgccgaggtggtgcgcgtgccaccgggcgcgccgatcggcgtggggagtgtggaattcgaggcggtggagctggaggcaccggtcggggcgacgctgctgctctacacggacggtctggtcgaatcccggctgcgggacgtgtgggtcggcatcgagcagttgcgggagcggctcgcgaccaccgccgaactgctgggtccggacggcccgccaccgctggaggctctgtgcgacgacgtcctggacgtgctcgtgcccggcggccgggacgacgacatcgcgttgctggccgcccgattcgacgggatcgagcccagtgacgtcgcgtactggatcctggacgccgaggacaccgctccgggccgtgcccgcaacttcgcccggaagacgctgacgaggtggggcctggaggaccccgaagacagactcgccctgctggtcagcgaggtggtgaccaatgcggtccggtacgcggagcggccggtggtcctgcggttgctgcgcctggacgtgctgcgctgcgaggtcggcgacgactccccgcggctgccccgccagcgccgggcccgggagaccgacgagggcgggcgcggcctgttcctggtcaaccggctgtcacagcgttggggtgccacccggaacagcagcggcaaggtcgtctggttcgaactggccctccccgaacagagcgcgacggggatcgagacgatggactgcccttaggaaatcaggtgctgcagttggtgatgacgacaggaggggcgcgtgcacgtttgcccagagctgggtttcttgcaggcagggcagggatagtccgggtcgtggggtgcgaggcggagggccccgggccgggggccgacctggcctggaggtatgcggggaaaatccaagggagcggacggccgcgcgctgctacggtcgggcgttatgagctggctccccgatgacttcgtccatcccgtcctgataccgctgccgggcagtggtcatcacctgcggccgatccgggaggcggacaccccgctcgactatccggctgtgatgggttcgcgcgagcggctgtggaccatcttcggcccagcctggggctggcccgcggccaccatgacctacgaggccgaccaggccgacctgttgcggcacgagaaggagatcgccgcacaccagtctttcaactacgcgctgttcgacgcggcggagacagctctgctcggctgcgtctacatcgacccgccggagaaggccggcgcggacgtcgagatctcctggtgggtggtggacgagctggtggacagcaaggtcgagcaggccctcgacgagctggtgccgcagtggatcgccgccgactggccgttcgagcagccgcgcttcctcggccgggagatctcctggtcggactggctcgccctgccggagcaccccgacgcgtaagtagcttttgtcgtaatgctctgggggctcggtgctcgaacggctgtctcgatcgggtggtcgtcgggtgctcggcgcatccgaggagggcctcctgaacagctcgctggtgtcgaaccaccgagcatcaggaggcctcgcgggtcgacccgccgcggcgtcatagccctcgtcttggacggcgacacggtcaccgaacgcttcgtacaccgtgaagtgcaggtcgccatgccgcgctccccgatccggtatcccccgggccggggcagccgggcgttcccttgtagggcaaggagtgtgggcaccaggtaggacgacgcgcggatccgtgcggccggggacgggccgagttccgcgggcacgacgtccgcgcgcaccgccgttttgcggtcggctacagggttcttgccggtaccccggatccgggtaggtctccgtcgaggctttcgcacggacgatttccggcccgccggacgccgttaccgcgaaggtgccgaagaaaggggcccgaaggccagaacccggttccctgccggtacagcacccgccgcttccttgcccgcacgctctccgcggccggccttcgggggagggggtggtgccgtcgcccgcgaaagccgggcagccgcgcgggaacagccggtcccgtcggcgtcgttgcaccgaacgggaggtcaggcgccgcgggggtgggaaagaggacatccgcccgggcgggatccggcctcccgggatcgcggaagacctgccgcgaacgccgaccgacacatgtctccgcaggaggactccttcatgactgaccggcccctgaccctcatggcagtgcatgcccaccccgacgacgaagccaccggaaccggaggcgttctcgcacggtacgcggcagagggcatccgcacggtcctcgtgacatgtaccgacggcggttgcggtgacgggccgggaggcgtcaagccgggtgatcccgggcacgatccggcggccgtcgcctcgatgcgccgacaggaactggaggcgagctgtgacgtcctgggtgtcagtgatctggagatgctggactatgccgactccgggatgatgggctggccgagcaacgacgcccctgggtccttctggaggacccccgtggaggaaggcgctgcccggctcgcggccctcatgcggcactaccggcccgatgtggtcgtcacctatgacgagaacggcttctacggccaccccgaccacatccaggcccaccgcatcacgatggcggcactggagatgaccgcgctgacgccgaaggtctactggacgacgatgccgcgctcggcgatggagcggttcggcaagatcatgcacgagttccatgaggacatgccggagcaggatcccgccgaagccgccgcgctggccgagatcggcctccccgacgacgagatcagcacgtgggtggacaccaccgcattcagcggtcagaagttcgacgcgctggccgcacatgccagtcagggcgagaacatcgtcttcctcaggatgggaaaggagaggttcggtgagctgatgggcgtggagaccttcgtccgtgtccaggacgccaccggagcggccgtgcccgagaacgatctcttctccggcctgcgctgatccggccgcccgtccggccggggccttgaccccgtggcattccgccccgccccggcgtcctatccgcggaagtgggcctggtgctcgtggaggaaggcgtcgagtgtgcggggcgggcggccgaggacgtcggtgaccgcggtggtcggggtctcgggccgcgtgacggcgagtcgctggatctccgtcacgtggtcggcgagccaggcgggcatgcgggcgtcgcggacgagccggtcgcgcagttcctccggcgtgaggtggacgtaacggatcggacggccggtcagggcggtcagccgggaggcgagatcggggtatgagacggcttcgggtccggtcagcgtgtggacgccgccggcgacgtccggcctggtgagggcggcggcggcgacgtcgccgatgtcgcggcaatcgatgtggttgaggggcgcgtcgcccgtcgtcccgaggatgacgccctgggcgacgacgccgggagccaggcgcaggaggttctgtgtgaacgcgtaggggcgcaggacggtgtgggtgatgccgacggcgcgcaggtgttcctcgacggcgtggtgtccgcgcgagacggcgaccggggagtcgggttcggcggcgggcgcggagatcttgacgatgtgtcggatgccggtgtgggcggcgatgtcgatcacgcgggtttcgagctcgacctgtgcggggctgttggccatggcgaggaagagctggtcggcgcccctgaaggcggtgcgcagcgagtgggggtcggtggcgtcggcgtaccgcacctcgacgagcgggcggtgcgtgccggtcgtgccgggaatcggcgtgtgcggggtgcgggtcagcgcgcggacggatgtgccgcgtgcgaggaggctgtggagcagcgcgttcccggtggctccggtcgctcccatgacaacgatcatcgtgtgctcattccttggtgatgtcccggcgacgggtggtgccgggggtcgggggtcggggcgggctatgacgcggtggtgccgcgccagcgcagggtgacgatggtggtggcgagggccgcggagacgggcaggtccacgcgcaggcgctccagccacagggaggcggggaccggcgtgtgcgcgggcagccactgggcggcgaaccatcccagcagggccgccgcgccgacggtggtgatcacgagcgcgccggtcaggacgccgcgcggcgtggtgagggtccaccctcgaggccgcccgccgcgccgcagccaggtgccgaccaggtacgccaccacggcggaggtgccggcgatggaggtgcaggcggccaccgccagatcccgctgcccggtgacgaggccggccgtaccggccgtcagcgcgggtgcggcgtaggcggtcagcacctcgcgccacaaggtgaacggccgtgacggccgtgacggccgggggactgctcggtttcggccggttctgtccttcgtcgcgggcatgctgacctctttctcgggtgtatgagggaaagcgatgtaattaggcagctaactatgtgggtgtaaaaaaggccccaccggtggagcggggccgaacggccgagggtcgggtcagtccgcggccagggccgtgctgccccgcacgacgcgggcgagcaggtcgaggaacaccgcgcgctcctcgacggagagcccgcccaccatcgcctccagccgcccgaaatgctcgggggccatctcgcgcaggcgctgcgccccgcgtgcggtcaggacggccaccgtgccccggccgtcctccgtcgacgggcggcgggcgatcagcccctcgcgctccaggccgtccagcaggccggtgaccgtggcccgggatacgccgaggtcgtccgcgaggtgtgaaggggatttctccccgccgtggtcttcgaggtcggcgagcaggcggtagcgccccgtcgacaggccgaacctggcgaaatgcgcctcggccgcccgcccgacccgcgcgcccgccgagatcagccggaccgcgaccagtaccgcttgcgggtcgacttccaggccgtagtgctcgacctgccgtctggcctggtcgagtgtgggcgcttcgccgtcgatgccgtccctcgtcatggaagtaatatggcggctaaccacttgggctgtcaaggatccggcaaggatccgccagggctctctcggggatctccggtgggcccggtccgcggggagggcggtcgccgccgggcctccctgccggggcgctcgggcgtgggtgcggaatcggccaagccggtgcgcgcgccgcgatccaccctcactgaaaggtatagaccaatgctacgttggtcgggcagaccgcgcagtccttgaccacccgtcagaggagaagtcatgccctccccttcgcggggtggcggccaggccgccatgcccaagtaccagtggatcgccgcagcgttgcgccgcgatctcgaccgcgccgcacacacccccggtggcagactgccctccgagcgcagtctcgccgcccggtaccaggtcaaccggcagaccatcagggcggccctccagcacctgcgccaggacggcctggtcgtcaccggccgccgcggcacccgcccggccgtcccggggaatccgcctgccgcgcctgccacgcccgccccgccccccgggaacgccgcccggacccggagctggatcactctcgtcaccgtcccgccctcgctcgccgcactgctcggcatggccggcggggaccgcaccctggtgcatcaccaccgtgaacgcggtccgggcggggaggccctgcggcatgccgtcacctacttcagccccggggtcgtcgagcggagccccgaactgacggccttccggaaccgggcgggggcgacgaccgcccgcgaacaggacctcacccccctgcatcgctggctcgaccgcgcagccgcggccgggcgggtcgccgagaccctcaccatgacccgcgtcacccacccgccggccaccgccccggcctgcgggctgaccgtgcgccgcaccctgcacgacacctccggccggctgctcgccgtcaccgacctggccttcccgacatgggaccggctcaccctccaccgcgaccgccgtgaccacgcgaccaccggcttccgcatcacgtaactgccggacgcgcgctgtggcctcggccacaccccgggcggcagcgcaccgggcccggcggccgcatcggtcgccgggctcccgccccaactcccctccagggggcgggcgtacccggtcacggccacccgcggccgcccggcccggggtgtgcggatccgcgtacggcgcccccgcgacccacacgtgaggagggtcaccccggcgtttgctcaggtgaatgcagggcatcggcgctgctggagcggaaccacgccctccggccgttcgtgccggagggcgcggcgcacgcgggccgatcccgtcccgctccacggcccgccggtccgccggcgcgcgccgtacttggtacgacccgtgaggtgtatgtgtccacgctccaggccgagcacgtctacaaggtgttcgggaggcgccccgccgacagcgcagccgccgtccgcgcactcgaaggcggtgcaggccgcgaggagttgcgcgccgacgggaccaccgctgccgtgatcgacgcctccttcgacgtccagccgggccagatcttcgtcgtcatggggctgtcgggatcgggcaagtccacgctgctgcgcatgctgaacgggctgctcgaacccacctcgggacgcatcctcttcggcgggcaggacctcacggccctgagcgcgagtgagctgcgccacgtacggtccaagaagatctccatggtcttccagcacttcgcgctgttcccgcaccgcaacgtgctggagaacgccggctacggccttgaggtgcagggcgtgccccgccccgagcgcgagcggcgcgccgccgaggccctggccctgtgcggactggaaggctgggagaagtcctggcccgacgagctctccggcggcatgcagcagcgggtcggcctcgcccgggccctggccacggacgccgagctcctgctgatggacgagtccttcagcgccctcgacccgctgatccgccgcgacatgcaggaccagctcctggagctccagacgcgtctgaagaagaccatcgtcttcatcacccacgacctcaacgaggccatgcgcctcggtgacggcatcgccgtcatgcgcgacggccgcatcgtccagcagggcacggccgaggacatcctcacccgccccgccgacgactacgtcgcctcgttcgtccaggacgtggaccgctcccgggtcctgacggccgatgccgtcatggacgatccggaaccggacgccgacgcctgcgactgccccaccgtcaccgccgggaccccgctcgccgacctgtgcgcggtcagcgcccgggtcccgcacgcggtcgccgtcaccggcacggacggtgccgtcatcggctcggtaccccaggagcgcctcatcgccttcatcggcgacgaacaacggcccccgatgtactgcgcggaggtggccgcctgatgccccgcctgcacctcggcgcctgggtcgacagcggagtcgacttcctccagagccacctgtcctggctgttcgaggccatcggttccctcgtcaccggcctctacgacggcgtcgacgccgtcctctccgcccccgccccgctgctcctcgcgggcatcctggccgtcgccgcctggtggctgcgcggtctgctggcgggcctgctcgccttcgcgggcttcgcactggtcgactccctcggcctgtggcaggaggccatgtccaccctgtccctggtcctggtcgccacgctcgtcaccctggcgttcgcgatcccgctcggcatctgggcctccagatccgaccgcgtcagcgccctcctgcggccggtcctggacttcatgcagaccatgccggccatggtctacctgatccccggcatcatcttcttcggggtgggcgtggtgcccggcatcatcgccaccatcatcttctcgctgccgcccggcgtgcggatgaccgagctcggcatccgccaggtcgacggggaactggtcgaggccgccgaggccttcggcaccagcccgcgcgacaccctcgtacgcgtccagctcccgctggccctgcccaccgtcatggccggcgtcaaccaggtcatcatgctgggcctgtccatggtcgtcatcgccggcatggtcggcggcggcggactcggcggcgccgtctacaaggccatcggcaacgtcgacatcggcctcggtttcgaggcgggcctgtccatcgtcgtcctcgccatgtacctggaccggatgaccggggcgctcggccgccacgtctccccgatcggccgccgtacgctcgccaaggcgcgggccgccgccaccggcgccgccaagctgtggaaccaccgcccccagcccgcgtacgcgatcagcggcgccgtcgtcctggcgctcgtcgcgggcggcctgaacaccttcggcggctccaccgccgaggagggtccggccggtgccgcgaacatcggcaagggccgcaccctctccgtcggctacatcccgtgggacgagggcatcgcctccaccttcctgtggaaggagctgctggagcgccgcggctacaaggtcgacgcccgccagctggaggccggagccctgtacaccggcctggccggcggcaagcttgacttccagaccgacgcctggctgcccgtcacccacgcccagtactgggagaagtacgggaacaagctggaggacctcggctcctggtacggccccacctccctggagctgtccgtgccgtcctacgtgaaggacgtgcactcgctcgccgacctcaagggcaaggcggaccggttcaagggccggatcatcggcatcgagccgagcgccggcgagatgtcgatcctcaaggacaaggtgctcaaggactacggcctcgacggcgagtacgaggtcgtcgacggctccacgcccggcatgcttgccgagctgaagcgggcctacgagaagaaggagcccgtcgcggtcgtcctgtggtccccgcactgggcctactcctcctacgagctcaccaagctggaggacccgcagggcgcctggggcaagggcgacggcatccacaccctggcccgcaagggcttcgcggaggacgagccgaaggtcgccgcatggctgaagtccttcaagctcaccgaggaacagctgaccggcctggaggccaggatccagcagaccgggaagggcaaggagcagcaggcggtccgcgcctggctccaggaccacccggaggccgaccggctcgcctgacaccgaaggcggccggacggcgaaggcgccgccgcacgcagggccccgtacgaccgtacggtcccgcgcgcggcggcgccttcgtcatgcccggggctgtcgctcagccgaccagcacccggtccgtgctcggccgccggtccgcgtcgatgtcccgctcagggtggcgcggacgcaccggccaccacatcgaccggcccagaagggcggccagcgcgggcaccagcacgatcgacaggacgaaggcggagagcatgatcccgagggccgtcgcgaaaccgatctgctgggtggacggggcgggggtgacggccaggctgccgaaggacgcggccagcaccaggcccgccgtggcgatggcgggcgccgtgtgccgcacggcgcgccccacggcggcgcgggccggaccgggccgggccatctcctcccggatccggtcgctcatcaggatgttgtagtcggtgcccagcgcgaccacgaacaggaacagcacgagcggcagggtgaagtccaccccggggcggtccagcgcgtgctggaacaccagggtcgaggcgccgagggtggccgcgaagcccagcccgaccgaggccagcaggatcaccggtgccagcaggctgcgcagcagggcgagcaggatcagcgcgatgagcgccgccgccaccgggaagaccacccgcaggtccttgtccaccgcggtggcgatgtcggcgaagacggccgccgtgccgcccacgtgcgcctgcgtaccgtcgggagtgtgcgccgcgaccgcggcccggaccgggcccgtcaccagatcgcgcgcggcctgcccctgcggatcggcggtcaggaacaggtcgatccgcgccgcccgccggtcctcggtcagtaccgtccgcgcgacctggcccacaccgcccaccccggcgagcgcctcggacagtccgccgaggcgttcggcgctcagagccgcgccgtcggaagcggtgacgaaaacgctcgtcggatccgacaccccggccggcagggcgcgggagatctccgccgcggtggccgtggcggcggtgcgctcgccgcccccaccgctctgcccgtagtccatgcgtacccccacgactccggcggccagcgtgccgagcagcgccaccgaggccaggaccaggacgaacggccggcgcgcgacccggtcgcccatccgcgcggcggaccccgcgcggggctcgtgccgcagggcccgggacggccagaacatcttgcggccggtgaccgctagcagggccggcatcagggtcaggctgcccagcagcatcaccagcaccgacagggcgatggccggaccgagcacccggaactggccgaaggaggcgaccccgagcgtggcgaaggcggcgacgatggtcagggccgcggaggtgatggccgtacccacccgcccggcgacatgggcggccgcttcgcgcccggactgctcggggtgctcgcgcagttgctcccggaagcggaagaggaggaacaggaagtagtcgatgccgatgcccatcagcaccacactgatcagactcggtgtggactccgagagcccgattccggtcagcagcgcggcgcccaccaccgcgcccgccgcggcgcccccgatgacggtgaccgcgagcagcggcagcagggcggccagggcgctgcggaagacgagcacgtgcaacaggacgatgaccgcgagcatggcgatgccgacggccttcgagcgggtctcctccgcctccgtcgtgtccacgcggtcggcgatgccgcccgtgaagccggtgcgcaggccctcctccgccagagcgtcccgggtcgagtcgcggaacgcccggtaggtgtcctgcaccccgggatcggcgggattcccggtcagttcgacggtcagcagccggaaggtgcggtcgggcgccgtcatggccgggctgacccgggggacctgcgagtggtcctgcgcgagcggcatcgtctcctcggtcctgggcatgacgacgcgctcgcgggccagccgtgcggcctgcgcgtcgatgcgctgctcgtcggcggcgccgaggggtgccccgtccgaccgggccaccagtaccgtcaggaggttggcgtccggcttcgccccgaaccgctcctcggcgatcttcagagcggccgccgagtcgtactgcgcgggcaggaacccgccgttgccggtctggacggcgcggaagacgaacgcctggcccaggacggccgccgccaatcccaggaccgcccacagggcgatgaccttccacggacttctcgtcgagaatccggtcagggcgcggatcacatttcctccggtctgtgcggtgccggccgggggttcccggcctgactccagaccatcaggggcgagcgggcgaaacgtcgggtcgggggaggatccgcaccccgggaccagggtccggcctcccgcgccgaccaggactccggtcctggtacgggccccgaccccggtcgggtggcaggggcggcggccggtgccagaatggatcaccgggggacaggacgggcgggtatgggggcgggcatgggtgcgggcatgggtgcgggcatgggtgcgggcatgggtgcggattcggttgcggccgctgccgctgccgcgggtacgggcagcgccgaggccaaaggcgcggacggaggtgccgagcgcggaccgtggacgcgcaacgacgcgctcgtggcgacggcggccggcgccacggacctcgtcgggttctccctgggagccctgaccgagggcaggtccctcagcgtgaccgcggccgccctgctggtcgtctcggcgatgaccctgctcgcccggcgcgtccacccgctgccggtcctcgccgccgtactggccctgggcgccctcgtgaacatggccgccccgctgtccccgcacttcaccctcagcctcacggtcgccctctactcggtggtcagggcctgccgccccgccgtggtcgcggtgacggtggccgccgcggtaccgctcgtgtccgcgggccagagcggctggccgctgccctacggctggtggggtctggccggaaacgcggtggccgccctcatcacggtcaccgcggccgtggtggtcaaccaccggcaacgggaggccgaggcccagcggatgcggcacgccgaccgggcggtcgccgacgagcggcggcggatcgcgcgcgaactgcacgacatcgtcgcccaccacatcaccaccatgcagctgatggccggcggggcgcgggccaacctggcctacgaccccgaggcgtcccgggaagcactggtcaccctggaggactcagggcggatggcgttgcgcgagatgcgccaactcctcgacgtactgcgcgccggggaggaaccggaggccaccccgccggcgccgcagcccggggccgacgacctggcccggatcatcacggagtcacggctggccgggacggagaccgagttcacggtggacggagcggtccgcccgctcccgcccacggtgggcctcaccgtcttccggatcgtccaggaggccctgaccaacacccgcaagcacgcgggcagggcgcgggcccacgtacggctcacgtaccacggggacgaggtgggcgtggaggtgcgcgacgacggggcgggagcacaggcaccgcccgcacgccccgcggcgcgctccgggtacggtctgatcggcatgcacgagcgggtcgccctgcagggcggaaccctggaggccgccgccctcgccggcggtggattccgggtggcggcacggatccccctccctgtccgagacaccccctgaagagaggaaccgcacggatgatccgtgtactcatcgccgacgaccagccgctggtccggcgcggcctggcgctgatcctgggtcccgacccggaggtcgaggtcgtgggcgaggccgaggacggggcccgggccgtggccctcgcccagcggctacggcccgacgtggtcgtcatggacatccgcatgccggtcatggacggggtcaaggccaccgaggaactcgcgcgcacgcttccggagacccgcgtgctggccctcagcaccttcgacatggacgagtacgtggtcgccgccctgcgcgccggcgcgtacggcttcctgccgaaggacatctccccggaagagctgatcgccgcggtccggatcgtccacaccggcgaggccgccgtcgcgccgcggctgctcagccggctcctctccgcctacgtacggacccccgcacggccgccgtcgtgggccgccgggaccccccacgaactcaccccgcgcgagctggagatctggcggctcatggccaccggccggggcaacgccgagatcgccgcggaactggacatcagcgtctccacggtcaagaaccacatcaccggcatcttcggcaagctgggtgtccgcgaccgcgcgcaggcggtgatcgcggcgtacgaatcgggcctggtggaggccggcggcgggagtggctgatcaccaagtgcccgtgagcggaccggattcctcctgaggaccgcacctctgaccagccggaacactggacgattcgcccgtgcgcacacgggccggtccatggcacagtgcgatcagcccaaccgcacgaccagggagcctccatgcgcgatccgcacgccccgccgctcacggcggctcccgagtgccgtgcggacccccgcccgctgccctgctgcccggtgtgcgcggacgcacccgaacgcatctcctggcgccagcgcccgggccggccggtgatcctggtcttcgacccctgcggccaccactggtcctccccggccccaccggtcctcacggtcaccccaccgctcccgacggcccggtaaacggcggggccaggcgacatcgagctcttcgcggagcgcgggaacgaggatgaagcacctgcggaaacgcggtcgccgagggggcgttcgcggaactcgcggagagggtcattcgtgagagtcgcggaccaccgccaacccgccgacccgggtcgtgatgcccgccggtccgcgtcgggccgaagcgagcacgctggccggtcgaccgagggtgtcgccctgctccacctcgatcgtgaccgtccgcgcccctgtcgtgtcgagcaggtgggcggccaggcagccggtgctgttggcgttggcgacgtcctcgtcgacgccgatcgccggcgcgaacatccgcgccgcacccggtcggtcgcccaccggtggtacgtacacgaaacagccgagtagcccgtaccgcctgcacgccgctgtcagcctgccgagatgtgggtggactcggagcagcgccgaccggtcgtggaccggtaccagcatgcgtggcgcgccgggcgaggcgatccgtggcgcgtcggtcggatgcggatcgtccgcggtgagcccgagcgcggcgacgatcgcggcgcgctcgtccggtgccgggtgacgcagcgcgacgaggccctggtcgaaccacacctcgatgctagcggagcggcggatcgcgacggtgtcgaacgtgcgcccgccggtgtgttggcggtcgttcagcccgcccagcgtggtgcgggtcaaccggacggcctgcgcggcaacagtgccgtggccgcagccggacagttcggcggtggcggtgaagaaccggaccggccggccgccgtccggcgtccgccccgggccgaggaacgccgcgtgcgaggtgccggccgcagcggcgaccgcacgccggtccgcgtccgtcgccgccgggtcgtcgtcggtgacggccgtggggctgccgccccggccgtcgcgccgcacgcacgcatcaaccaccgtgacatcccgccaggacatcggcccccctctttgacgttcagcgatccggcaaccgcgaacggcgtccgccgatagccggacctggccgcaacggccgaccgaacgcgtcccggagcgtaccgtcctgcctcggccggtgccgcgccctcccgtacggagacggccacggccaccttccaggcctcacgttcacctgatggatgctcaaacatgcttgatgacagtcgacttcgagcatcatctttcactgaggcccgtcggagcgctatcttgccgggagcatgccaaggagctgtgtccgtgtccggaccgcacgaggagctgccccatgagactgccaagcatccgcaggagccagggtcggcaaggcccgtcaggcagccgagttcacgcggcgcggcgggggcgcaggcggcgcaccccggccgtcgccctgctcgccgccgccctcaccgtcgcgggtctggccgccgccggaccggtcgccttaccggcctccgcctcagcctccgcccctgccggccccgccgaggccacggcaacggccggcgacgtcaccggcttcacccggtccgggaacaccttcaccgtcacggcctccggcggcgccaaggcccgcgtggtggtcgcccgcgccgacatcttccgcctctggctctcgcccgacgggtccttcaccgacgatccggccggcaccgacctcgcccccaccaccgacttcggttccgtgcccacgagctggtcggacgccggcgcgtactaccggatcaccaccggatccctctcgatccgggtcaacaagaagcccctgcggttctccgtctaccgcgcggacaacaccacccccgtctggcaggagacccggcccaccagctggaccggcggccgcaccacccagtacctggcccggggcgcggacgagcagttctacggcacgggcctgcgcctgggcgagtgggcgctgcgcgggaagaccgtcccggtcgccgtcgacaacaagtggcgtgagaacgacaacgccagccccgcccccttctacatgtccaccaacggctacggcgccatgcgcaacacctgggccccgggctcctacggcttcgacgcgcccaccaccctcacccacgacgagaagcgcttcgacgcctggtacttcaccggcgactccctcaagtccgtgctcgacgcgtacaccgacgtcagcggcaagcccttcctggccccgatgtggggcttcgagctcggcaacgccgactgcttcaacgcctccaaccccgactaccagggcgatcacgaccggctccgccaccaaaccacccccgacgtcgtcggttacgcggccgacgcccgggccgccgacatgccctcgggctggttcctgcccaacgacggctacggctgcggctacaccgcgcccctcaagtcgaccgtcgacgccctgaaggccaagggcttccagaccggcctgtggacctccaccggcctcgggtccatcgccgacgaggtgggcacggccggcagccggggcgtgaagaccgacgtggcctggatcggcagcggctacaagtacgccttcgacggcgtgcggcaggccgtggacgggatcgagaagaactccgacgcccgccgcttcgtctggaccgtcgacggctgggcgggcacccagcgcaacgccgtcgtctggaccggcgacacgtacggcacctgggacgacatgcgctggcacgtccccgccatcaccggagcgggtctgtccggcctcaactacgcggccggcgacatcgacggcatcttcggcggcagcccgcagacgtacacccgggacctgcagtggaaggccttcaccccggccttcatgaccatgtccggctggggcgcgaccggcccgtccgccggctaccacgacaagcagccctggcggttcgccgagccgtacctgtccatcaaccgcaagtacctgcagctcaagatgcggttgatgccgtacctgtacacgatgagccgcgtcgcccacgagagcggcgtgcccagcacccgcgccatggtcctggagtaccccgacgacccggtggcccgcggcaacctcaccagcggccagttcatggccggtgactccctgctcgtcgcacccgtcgtctccgacacctccgtccgcgacggcatctacctccccgccgggacctggaccgactactggacgggccgtacctacgcgggcccgggctggctgaacgggtaccaggcgccgctggagaccctgccgctcttcgtcaagggcggcgccgtcgtaccgatgtggccgcagatgaaccacacgggcgagaagcccgtctcgaccctcacctacgacatccacccgcgcggtgcctccaccttcagcctctacgaggacgacggccgcacccgcgcccacgagtccggcgcctacgcccgccagcgggtcgacgtcgccgccccgaccggcggctccggtacggtcaccgtctccgtgggcgcccccaccggcagctacaccggcaaacccgcctcccgggcctacgagttcaccctgcacgtggccaccgcacccgccaccgtcaccctggacgggagccccctgacgggcctgtcctccagggccgcctacgacaccgccgcgtccggctggtacttcgacccggcggaccgctccggcgtcctccgggtcaagacgcccgccacggcaggcgcgttcagcgtctcggccaccggcaccgccgtccccgaggccgcggcgctgccctcctcatccgctccgctcgaccggtccgcctggtccctggtccacgccgacagccaggagagcgccgccgagaacggcgcagccgcgcacgccttcgacgggaacccggccaccctgtggcacaccgcctggtccccggcgaagcccgccccgctcccgcacgagatccagctcgacctcggcgcccgctacacggtggacggcctcggctacctgccgcgccaggacggcggcgtcaacggccggatcggcggatacgaggtctacgtgtccgacagcaccgccgactgggggccacccgtggcgagcggtaccttcgccgacaccgcggccgccaagtccgcggcgctcgcgccgaagaagggccgctacctccgcctgaaagcactgaccgaggccggcggccgcggcccctggaccagcgccgccgagatcaccctcaccgggcggcccgccccctgaccggttcaaccctccccgtcgccgagcacggcccggcactcccgccgggccggctcgctcagcagcgggcgcaaccctgcgaacagtgcccggagtcgggcaccccacgcgtcgcggaaggcgggatcgacccatgccaggtcgagctcgttggccgccgacagctcggcgaggtcccgccggagctccagggcgggggagtggacgcggccggtgaaccggtcccggaaggaagcctcctcgcgggcgagcgtcggatacgaggccgcccggtcgcaggcggcgtacgcgtacacgatctcctcggcctggtcgccgatcaccgcggccagttcggcccgccgggagagcggcagcagggcggtgggaaaaccgtccgtaccgtagaacgcgtggcacaggccggcccggcggagcgccggccgcgccccccaggacgccaggagtccctgcacgcgctcaaggtgtgcgaggagggtcccgcccggatgggcgaggtgctgcgcaccgagctcccgcagccatgcgacggcatgatccggcaccggcgtctcccttcggtcagcggtcagcggtcagcggtcagcggtcagcgggcggcgggtcgggtgggtcgggcaggtcgggtgggctgggtgggctgggtgggtccggtgggccgggtgggtcggcacccgtccctgcccgtacctgggttccggaccccgtggcgcggtcggggacgggttgccgcccgggccctgcatcgatcttgatcccatccaaaacccaagtcaatcctccgatttgctctctgcatccaagcgataccttggatctcatgaccctcgatgatcttcgtgtgttcgtggccgtctgccgctccggcagcctcagcgccgtggcccgcgatctcggctgcacccagtcggccgtcagccagcacatccgccgactggagaagcggaccggcgccagcctcctggagcgccacgcccgtggcgtcgtacccaccgaggccggccgcatcctccggacggccgccgccgagggcatcgccggactcgacggcgccctgcgccgcctcgacgacctcgtccggggcggcggcggcaccgtccgcgtcaccacgggagcgacgacggtgcggcacttcatgtccgaggccgtcgtcaccttccgccgcagccaccccgaggtgagcctggagttccagaccgagaactccagccgcagctgcttcgacgccctcgccgccgacgacctcgacctcgcctggatcaccatcggcgccccggtccgcggcatcgagctgcgccccgtcatggagctgccctgggtactcgccgtcggcgccgacgaccccctcgccggccgcgcccgcatcgaccccgccgacctcgccggcatccgtcacatccggctgcccgagaactccgcctcccgcgcccacctcgacgccgccttcgccgcctcaggcatccgggtcagctccgacaccagcgtggccgactgggacaccgccctgctgctcgccgaactgggcctcgggcacgccgtcgtgcccgcgctgcccggctggcaggtccccggctcggacggcccgctgcgcctcgtgccgatccccgcgctgccgcccctcgcggtcggctgggccgttcgccgctgggccgccctcgcccggccggccctcgtcttcgccgacgaggtcgcccgcagctgccgggcgcgcgccgccgggcagcagtgacgccgccgccagcccggccgccgccagtacggcgagcaccaccagcgccgcgccgtgcgacccggcgctcgcggcgaccgcgatcccgagggcggggccgatgttcatcgacgtctgcttgagccccccgacgaccccggcgtacccggccggggcctcgccgaccacggccccggtggccgtgaccatgaccgtggtgaacccggcgccgagcaccccgaaggccaccgccgaagcggagcccagcccggcgatcccggcgacgaccagccccgtaccggccagcgcggtgcggcgggccccgaaccggcgcagcgccaggcccgccaccggcgcccccgcgaccatcgccgcggtcagcggcagcacccgcaccccggtggcgagcgggtccagccccgctccgtcctgcaggtggaacgtggcggtgaacagggccccgaacatgcccgcggagacgatcagcagcagccccatcgaggccgtcaccgccgtggaacgggccacggcgtgcggtacgaacggccgcgccgcccgccgctcgcggcgtacgaacagggccgcgagccccgcggcggccccgaagccgatgacggtgggcgcggcggtccacccgtactcgggcacgccgaccagcgcgtgcacgaacaccgccagggcggtggcgagcagggcggcgccggcgagttccagccgcccgcgctccgcacgcggcggcgcgggggcccgtacggcgagcgtcagcgcggcgatcaccagggccaccggcacattgatcacgaacaccgcccgccagtcccaccgggcgaccagcacgcccccgagcagtggaccgaccgccgcggccgcaccgatcgcgctggtccgtacggcgaccggaacggcgagccggtcggccgggtacgcgagccgcagcagcgccagcgtcgcgggctgcagcagcgcgccgaacacgccctgcgcggcgcgcagcgcgatcacccagcccacgccgggcgcgaacacgatgccggccgaggccgcggcgaacccgagcacgccgacgaagagcagccgggggtgcccgtaccggtcaccgaggcgcccggccacgaccaggaacgcggccacggccagcagataggcggtactggtccactggacctgcgccacgctcgcccccaggtcgcggcgcaggctcggctgcgccacggtcagcacggtgccgtccagtgcgacgagcatggctcccgccacgctgacgagcagtgagatccgctgcctcatacgggctccggacccagatgcgcgtcgacggcggcgccgacgagccgttcgacgccgccgtccgtcgcgccgccgaggaccagcggcaggctcccccagcgccacaactgcgccacgccgtgcaggttggcccacaacgcggcggcggtgacggagggttcggcggctccgcaccggcgaacgagcgtgaccaggagatcgaacagcgggagcgtcgactcccgcagccgcggtccttcggagggcccctggcccgtactgtccagcaggtcgtgccggaacatcagcgcgaacatccccgcgcgctccagcgcgtagtcgacgtaggcgcacccgatcgtccgcacccgcgcccgcggcgtcaggtccggagcaccgaccaccgccgcgacgcgcacgccgagatcctcgaacccgcgccgggcgatcgccgacagcagggaccggtgggtggggaagtaccggcgcggcgccccgtgcgagacaccggcgcggcgggcgatctcccgcagcccgacggcgtcggcgccctcgctcaggacgagttccacacctgcgtcgatcagccgctcccggagcggtctctcctggtccatggagactgtctaccagggtgggtagacagtgtctactggttctcgccgctgggcggcgggcttactcggcccgtcaggccacggacaggacgatctttccccgggtgcgtccgccctcgccgagcgcatgagccctggccacgtcctccagggggaacatcgcggcgacctcgacccgcagccggccgctgtcgatcagggcggcgaccgcgcgcagagcggcctggtcgggctccacgagcatgaacacggcgcggacgccggccgcgcgggcctgttcggccgggaacgtctcgtccaggggcacgatggagaccagcgttccgccgggccgcagggtgctcagggagcgggaccagtaggcgggtccgacggcgtcgaggacgacgtcgacgtcgccgacggcccccgcgaagtcctggcgggtgtggtcgacgagttcgtcggcgcccagtgcgcgcaggaagccgtgcccggcctcacgggcggtgccgatgacgtacgcgccccgggacttggcgatctgcacggcgaggtggccgacaccgcccgccgccgcgtggatcaggacgcggctgcccggcccgacgccggccgtgtcgaccagggcctgccaggccgtgagggccgccagcgggacggccgccgcacggacgtggtcgagtcgctcggggcggtgggcgaaatggcgggccggagccgtgacgtagtcggcgtaggccccggccgggtgcgggaagcgtggcatgccgaacaccgcgtcgccgggctggaagacggtgacgccgcggccgacctcctcgacgacgccggagacgtcgaagcccaatgtgaacggggtggtcgcgcccgtggagaacgcgccccgcgaacgggtctgccagtccgccgggttgacgcccgcggcgtgcacccggaccaggatctcggtcgggccgggactcggccgttcggtctcgacgagccggagcacttccggtccgccggggccgtcctgggtgacggcgcgcatcatcggacgggcttcgtgggtcatggcgatcgctttcgggagggaatcagtgggttcataccccttcgtcagggcacgttcccaggctgccgcgagggggaggggccggacagcggcccgatggtcaacacctgaaaggatcgggtcatgcaccgcatcggagtcctcgccctggacggcgtgctgcccttcgaactgggcatcgcggcccgcgtcttcggcgcggcacgcgacgcggagggcgacgccctctactccgtgaccacgtgcagcctggacggcggcccggtgcggaccgattccgactaccgactcgccgtggcgcacgacgcgtccgtcctcgccgacgtcgacacggtggtcatcccgccctcccgcggcctggggccgatccgcaccgaaggcctcctcccggacgccctgcgcaccgtcctcgccgccgtccggcccggcacgcggatggtggcgatttgcaccggcgcctacgttctggccgccgcgggcctcctcgacggccgttcggccaccacccactggcgtgaggcggaccggctgcggcggacgttcacccgggtgcgcgtcgaccccgacgtgctgttcgtcgacgacggcgacgtgctgacctcggccggggtcgccgccggcatcgacctgtgcctgcacatcgtccgccgtgaccacggcagcgagatcgccaacgaggtggcgcgtgcctgtgttgtcccgccgtggcgtgacggcgggcaggcgcagtacatccgccgccccgtgcccgagcccacggccgacggtacggcccccacgcgcgcctgggtcctggaacggctcggcgagcccgtgaccctggccgacatggccgcgcacgccaaggtcagcgtccggaccttcacccgccgcttccgggacgaggtcggagcgagccccggacgatggctcgtgcagcagcggatcgagcgggcccggcacctgctggagaccacggactggacggtcgacacggtggccgcccgcgcgggcctcggcaccggcacctcgctgcgccagcacctgcgcaccgccatcggtgtctcgccgcaggcgtaccgccgcaccttccgtgcggcgcgcccggccccggaggcccgctcccgcggtgcgggggatgatggagtggccggggaggcaggcccagtgtgatcccgcggcccggtggaggaggtgcacgtgccatgacggagcacgacggcggtccggcggcgcagaaactggaagagggccggctgctcaaagagctggaagccatccaccggacgcgccacgagaccctgttgcacgggtccgacgacgccctggtcacccatacgaagcggatgaacgagctggagcacgagtacgtgcgccgccacccgcagcgagcccagaccgcaagccgcacccgctcgggagcccgcgcccgcagcaccggcgactaaggggtgtcctgccgtctcctccgacggaagggcggccggctccgcgaaatgatctccacctcgacgacgggacctgcccgtctcgtgggtcttctttgcatcgaatgagacaaacttgtatcgttcgaggcgaaggaggctcacacgtggtgaatgaagaagagctgctggacggcgccgcccgcgtcctcgccggcgatcacagcgcctcgatggtgcagatcgccgccggcatcggcaccagccgcgccaccctgagccgccgctacgcgacccgcgaagccctgctcaaggccgtcgccgtccgggccatcgaggtcgtcgacggctgcctggcgccgctcgatctcacgcggagcgccgacgccgccgccttcgacgccgccatcgaggaattggtcgtcgccctgatgccggccgcgcacctgtacggcttcacctcgcgcgacgccaccgtcctcgcggatcccgagttccgggccggcgtggaccggcaggaccagcaggccgtggccttcctcgcccacggccagcggctgggccggctgcgcgcggacctgccgccgtactggatctggtactcgctctggggcctgctcgacgccgccgccgagggggtgcgcgacggccacttcgccccgcgccagatcggccacctggtgctgacctccttcctcagcgggacacggccgctcgcgcagccccccgcgggccctcccgcgccctgaactcccctccaccgtgcgcacacggcgcacctctgaacggaacctcatgcacacccctgcgcaggccccgcacaggtggatcgtcctggcgatcctctccggcagcctcctgctcatctccatggacaccacgatcctcaacgtggccttcccctcgctcgtcggcgacctccagccgggcgccgtccagcagctgtggatcatcgacgtctacgcgctcgccctgtccggactcctggtcaccgcgggcgcgctgggtgaccgctgggggcgcaagcggctgctcatggcgggcttcggcatcttctcggccgcctcgctcatggccgtgttcgccaccgaggcctggcacgtcatagccgcccgcgccctgctcggcatcggcggcgccgccatcatgccgtccaccgtgtcgatcctgcgcaccgtcttcaccgacgccagggagcgcgccttcgccctcgccgtctgggcggccgtcttcggcggcggcatggccttcgggccggtcgtcggcggactcctggtccaggactacggctggcactccgccttcctcctcaacctccccgtcgccgccgtcatcgtcgcggccggactgcgctacctgcccgaatcgcgctccccgcgcagcagcggcgcatgggactggtggggcgtcggccagtccgtcgtcggcatgctcgccctcgcgggcggcatcaagcagctcggcaagagcggcgtcgccgacccggtgccctgggccctgctcctgatcgccgccgccctgctgacggtcttcgtacgccgccagctgcgcctggacaacccgctgctgcaggtacggctgttcgccaagcccgccttcagcgtcgccgccaccgcgatcttcctgcccatggtgggcatgggcgcgatcctcttcctcgtcacccagtggttccagtacggcgagggctacaccccgctggaggccggactgcgcctgctgcccgccccgctcgcgctgatcgccgcctcgatggtggccccgtcgctgatgcaccgcttcgccatccgccacgtgctcggcgccgggctcgtcgtcctggcctccggcatggccctgccctggaccttccagcagttcaccgacctcggctaccaggccttcgccgccgccctggcggtgatgggcctgggcgccggcctcgccaccaccgtggcctcggtgaccctggtctccgccgctcccgcagccgaggtctccagcgccgccgccatcgaggagacctgctacgaactaggctcggccatgggtgtcgccgtcctcggctccaccgcggcggcgctctaccggggcaacctgcccgccctggagctggacggcccgagcaccgccgccgtacagggctccgtcggcgaggccgcgcacaccgccgaacgcatcggcggcgccgtcggccaggccctgctcgacaccgcctcgcacgcctacaccctggcgatcactccggccttcctgctggccgccgtactcgcggtcgcggcggcggccacgacctggacgctcattccgcgggacctgcagcccaccgagaaccactgacccgggcgggcagcaccgcgggcgcggcgggcgccgggcccaaggtggtggtgccgggcgccgcccggtgccccaggcccgttcggtacgcgtccatggccgcctcgacccggcccgtacgccgcagcagatcacccagcagccggcacaggtccgcgagatcgcccgtcgccccgctgcgttccagcagggccagcgcctgtacgtagtgctcctcggcggactcccactccccgcgcgcctcggccatcaggccgaggagccggtgcgcgccgcccgcgtgcacggcgccgtggctgtcccccagctccagcagggccgagagcagtccggccgcctcctcgtaccggccgagctggcgcagtacgtcggccagctcgacctccacctgggccgtgtagagtccggcgcggcgagccgacagcatgtcccgggctatgcgcaactcacgctccgccgaagcgagttcgccgttctgtgcctgtacgtagccgcgcatccagtggcagtgcgccagatcggtccgcagccgcagctgcccgtagatctcctgggccttcgccagtgaggcgtcggcgtcggccacccgccccccggccaggaaggtccgggcgacctgccggtgcatgccggccaccagggccgggtcgccgacctgcggagccagggcgagcgcgacctcggcggcgtgggcggcgcgggcgtgggcgcccatgtcgaggtacggcccgatgatcgcggcgttgagcagaaccagcgcctcggggtcggccagcccgctcgcgcccagctcgtcgatggcggattcgagcaggtagcaggcgtagcggagctcaccggcgagcaggtgcgcgaccgcccggccgcggaccggccgggcccggcgggggagcggctcggccgcgaggaggcgctccgccgcctcgaagtgtgtgatcgcctcgggcagttcaccggactccagcgcgcagtcgccgagcccgagccgggcctccgcctgctccgggaccagcccgagatcctcggcctcggcgagcagccgccggtagcgcgcggcggcctcgtcggccgcgcccgtggcgagcgtctgctgggcgtcggtgagggcgagccgcagttcggtggcgaggtgggcggggcggccggtggtgagctcctcgtacgaggtgcccaggcgggcggcgaggaagcgcagcgcggtctcggagggccggaccttgcccgactccagggtggagatgtaggccgaggtataggcgggctccgccaactgcttctgtgtcaggccgagttcaccgcgcatgtgcgcaaccctgcgcccgatccgggccggttcgtccatcgattccccctggtcgctcgaactccccagtattcagggggagcaggcattgcgcacgccccgcgcgccacctagtttaagcaaccgattcaccgcgcttaacaaactacttaacttccgcccccgggggagtacttcatggatccagtcagagtctcggtcaggcgctcggtgttgcgcgcggccgtcgcgacgatctgcgccaccgccgcgctggtggccgccggacccgcgggcgcggccgacgccccggcggggcaccggatcgaggtcgagatacccgggcccgagcacggcggtgacgccgggtcgggccacgcccgcgtaccggccgcgggcagccccgccaaggcgtcgggccggctgtccccggccgagcggtcggccgacggccaggtcaccaagctgatcgacaacggctccaccgccgaccgcctcgacgtcgtggtcatcggtgacggttacaccgccgcggagctggcacggttccacaccgacgccgagcagaaatgggccgaggtgaccgccgtcgagccctacaccacgtaccggaacctcttcaacgtctggacggtcgacgccgtctcgcacgactccggagtctccggcgaccccgacccggccaccgtccgcgacaccgccctcggctcctccttctggtgcgaggacatcgagcggctgctctgcgtcgaccagcccaaggtggacgcgtacgtggccaaggctcctgccgccgacctcgtcatcgtcctggccaacagcgccaagtacggcggcgcgggctacaacgagcgcaatgccgccctcgggtacgaggggatatcgacggcatccgcgggtcacccgaagtccggccaggtggccatccacgagaccggtcactccctcggcaagctcgccgacgagtacttctacccgggcgtcccggagtacgagaagtacacgggccccgagcccgtcgaatccaacagctcggccctgccggccgaccgcatggccgagcagcggaccaagtggtaccgctggctcggcgaggaatcacccgacggcggcaccgtgggcgcctacgagggcggcaactacttcgtgaccgggctgaaccggcccaccgacaactcgctcatgcgggtcctgggcaagcccttcaacctgcccggcgtcgagtcgatgatcgccgggttctaccagcacgcgcggatcgtcaccccgctcaccccgaccgaccgcaccctgcggctgcgccactccgcgaaggtgtccgtaccgaagctggccggcgcggacggccgccaacccgtggtccgctggtacctcgacggccgggagctgaagcgcttcgagggccgcaggacggtgtcggtggcggaactgtggctcttcgacctccgtacgcaccgcctgacggtcacggccgaggaccgcaccccgtcggtgcgcgacccgaaggtgatccgtaccctgcgctcctcggccgactggaacgtccggctctgacgaactccgttgtcagtggctcctcctagtgtgaagccatcactcggggagccacggagaaggagcagaaccatgtccgccaacaggatccagcacaaggtgaaccacgtcgcgctggtcgtggactgctcgggttccatgcgtcagcaccagggccaactgatccgcgtggtcgacgagttcgtggcgggtctcaaggccgagtcggacagtctcggtcacgagacccgtatcagcctctactccttcgaccacaaggtggagaacctggtctgggacatggacgtgaagcacctgccgtccatgcggggtctgtacaaggtcaacaacggtgcgaccgccctgatcgaggcctcgctgaagtcgctggacgacctgggccacatctgggaggagtacggcgagcacagcttcctccagatcgtggtgacggacggcgaggagaacgcctccggcggcgaccggcggcacgacggcgacatgacgatcctcggcccctggctcgacaggatcacgtcgaagatgggcacgctcccgggccactggacgtccgcgatcctcgttccgaactccctggcgaagcggaccgcccagaactacggtttcccggccggcaacatcgccatctggaacgcggattcgcaggagggcgtcgaggaggcgatcggcacggtgcgtgccgccgccaccagcttcctgcgcggccgcgagaagggcgtccgcggtacgaagaacctgttcgcggtcggccaggacctctcggtcgacgacgtacgggcgaagctcgaaccggtcccggccgacaagtaccggctgctgaaggtcgacgaggaggtcgcgatccggtccttcgtcgactcgcatccgggcgtggcgtacgagcgcggctcgtgctactaccagctgggaagccgggttcaggtgcaggccgacaaggaagtcatcgtggtcgagaagagcaccgaccgcgcgtacacgggcgatgcggcgcgcagtctcctgttcggcacgggcatccaggggaccgtctccgtgaaggcggggtgcaatcccgagctggaggtgtacgtccagagccgttcggtgaaccggaagctcaagcccaggacccgtctgctcatcatgctctgaacgagcccgaccaccgaccgcggacccggccccggtgaccacgcggcggccggtggccgcggcgacggggatcgcggcggccaccggccggtgggggaggcgtacgggctacatggggtccatgccccggtcgtccatacggccctcctgctcgctctgctcctggaggcggcgcgccttctccttcagccggcggcgctcctccgggtcggtggaccgctcggccgcgtcgttcagctctttggccttggcgcgcatctgctgggaccggccgcgggactcacctgaaacgctcatgatcgctccttggatctgtggggagagcgggcggactcagcgaatcagtactgccgtgcgtgcgcatctcgaaacgtcaccgagtgtgaatctccccccacaccgatgcaggaggggcggtcagtccgggtccgacccgagggcggtggtcagggtgaacagagccccgtccgggtcgcggagcgtcacccaccgctccagggcgttcgaggtgacatccgagacgggccgcccgcccagcgagacggcggcctccaccgcgggccggagcttcggcacccggaagtggacgtgccagcggggcctggtgtgcggggagtaggaggccatctccacgggaccgctgttcaggcgggcgacgggctcgccgtcctgccgcagcacgacctggtcctcctcgtacgagacctcgcagcagccggcgcggccggtggcccattccagcaccgcgccgtagaagatcgccgcgtccagcgcgttcctcgtgcgcagttcgagccaggcgggtgacgggcccctgcccacccgccagtccgcctccacattgccctcccagattccgaagacggccccgtccgggtccgcgacgagggcggcgcggccgcccgaatcgaaggagaccgggccgaccgcgatcgtgcccgtccgctcccggatccggtccaccgccacatcggcgtcgtcgaccgcgaaatacggggtccaggctgcggcgacccccaggtccgcggccagcgccccgatgcccgccaccgggacacggccctggaacgccaccgagaacgcctcgccgaggcgggtcggacggaatctccagcccacgaccgcaccgtagaagtgctgggccgtgccgaggtcgcgtgtcatcaggctcacccagcagggtgccccgaagacttccctcgtcgaaatctccaccactctctccgtccctgaccagccgttcgccctccccctcattctggtccttatcgtgatgatcctcgcgaccgacgggagtgaatgcacacagaaggtcgcccatcgttacgctccgtgtcggttctcgtcgaactcgtggctgatcctggagcgccggggcgcgagcgctgcgccaacgacccggcgtccccgaacacgctcatcgcgagctccgccgcctcccaccgcggcccgagggataacctcggtcccggacgccctcgcagccccggaaggcaggtctcccatggccggatcccagattcccgtgatcgatctcgggccgtggcggtccggcggacccgaggcgcgcgcccgtacggcggtccgcgtcgacgaggccctgcgcgcggccggcttcctcctggtgaccgggcacggcgtcgaccccgcgctgcccgcgaggatccgggaggccgcgggtgagttcttccggctgcccgcgcgcgccaaggcgccgtacgccgtcagggtcggcggccggggctggctcggccccggggcggaggccaacagctacgccgagggccaggcctcaccaccggacctcaaggaatcgtggtccttcgcggccgaggaccccaccggcgtcccctccgtggacaccgaatggttcgcgcccaacacctggccggccgaagtgcccgagctgaggcccctggtgacggagtacctgcgcctgatgcgcaccctctccgacgagctgctggaactcctggccggggccctgggcctggccgaggaccacttcacccgccacacctcacaccccacctgggggttcaacctcaactggtacccgggcaccgaggtcgtcggcccgccgctgcccggccagttccgtatcggcgcgcacaccgacttcggtacggtcacggtcctcgaccggcagctgggcgcgggcgggctccagatccacaccgaggccgacggctggcaggacgcgcccttcgaccccggggcgctcaccgtcaacatcggcgacctgatggcccgctggacgggtgaccgctggcgcgcgggccgccaccgggtactgccaccgcccgccgacacgcccgccgaggagctgatctccctcgtctacttctacgaatgcgacccgcacacccgggtggagtccctgcccgcccccgtcggccgggtggtgcacgaccccgtcgactcccacacgtacctgcggggcaaactcgacgcgatcagcgtggctcatcctcaggagtgaccgggagccaccccctccctccgaggtcggacagcggatcggtctctcagctgacgaaccgccaggaccttccgcatagcgtgaagttcatgacgaaccgcagaaccgttgcctccgtgactcttctcgccctgctcctgccgatcccgctcgtcaccgccggaacctcgttcgccgcggacacctccgtggcggccgggcccgcggcggcggacaccgtaagccgccgtacggcggtggaactcccgcgtccgaccggccgtttcgccgtcggccgggaggacctgcacctggtggaccacagccgcacggacccctgggccggatccgggccccgcgagctcatggtcaccatgcgctacccggcgcggcacgacaccggccggaccacgcgctacctcacctccgaggaggcccgcctgctgctcgtcgaccgcgggctggaccaggtcatcccggtcgagaccctgaccggcacacggtcccacgcccggaccggcgcgcgcccggccgccggacggtacccgctggtcgtgctctccccggggttcaccgtccaccgggccaccctcacggcgctcgccgaggacctggcctcccgcggctacgtcgtcgccgcggtggaccacgcctacgagagcgtgggcaccgccttccccggcggccgcgtgctgcagtgcctggcctgcgagaaggtccagggcgaggagggctaccggaccgtcggcgagacccgggcccgtgacgtgtccttcctcctggaccgccttaccggacgcgaccccgtatggcgccacgccggactcatcgacaagggccgcatcgcgatggccggccattccatcggcggctcctcgaccgcggccgcgatggccgccgaccacaggatccgtgccggggtcaacatggacggcggcttctccaccccggtccccgcggccggactcggcgggcgccccttcatgctgctcggcgcacagcagcggcgtcccggcggcaacgcgagctgggaccgcgactggccgctgctcgacggctggaagcgctggatcaccttcgccgactccggacacttcaccttcaccgacttcccggcgatcggcgaacagctgggcctgcccgacggagaggccccgctgcccggcgcccgctccgtcgaactgacccggcgctacgtcgcggccttcttcgaccagcacctggggggcaggccgcagcccgtgctcgacggcccgtcgcccgacgcgccggaagtcggcttccacaccccctgactcctgccggtcagaccaccgtcacggggtggcggaccacggcgtcgaagaggtacccctgcgtgttgtggaccgaccggtcgggctgggtccgcccggtcgcgtcggtcgcccgcgccagcagcgaggtcgcacccgtggccctcggggtccacggcagcgaccagcgcacccagccaccccggcgcggggtgtcgtgcagccgggcccgccgccagtggccgccgctgtccgtgctcacgtcgatacgcgtgaccggtgccgccgccgaccaggaacggccggtcagcagccgcgtccggtgcacggcgacggtggctcccagctccagctcgaaggcgctcttgagggtctgccgggtcagcggggcaccgccctgtgccgggtgctcgggcccgaacagccggtacatgtccgtgttccacggtgagtacagcggctccgtgctcacctcgatgtccccgacccacttgatcgacgagatcccgacccagtccggcaccacgaggcggaccggcccgccgtggtcgggcggcagcggccgcccgttcatctcgtaggccagcagtacgtcgtccagcgccttcacgaccggcagcgggcgccgcacccggcccaggttcacgccgttcgccaccacctcgtcgtccagcccgcgcggcaggacgtccacggcgccccgggtcacccccgccaggcgcagtacgtccgacagccgcgcgccgcgccagcgcgcgacgccgatcgcgcccagggtccaggcggtgccggtgaccggctggccctgctgcgtggtgtagaagctccggccgttgcccgcgcactcgatgaacagcgtccgctccaccggccgcagggcgcgcagccgctcgtacgacagttccagcgggccgcccgcgagcccgtcgccccacaccgtcagccgccacccggcggcatccacgcgcggcgtggaggtgtggttgcgcacgaagaaccggtcgatcggggtgagcgggcccgtgccgcgcagcgccgcgaagttcgtctccgcgttcgtaccgcggagcgtgaacagctcgggcggcagcggcttgacggtgcgcggtaccgggtcggcgaccggtgccccggcggccgccgaggccgtggcgccgccgacggccagctccagcgttccggcagcggcccccgccgcgaacagcttcagcagatcgcggcggtccattccggcggagcgggcgcggccgcgggcccactgccgcaggcgcgtacggtcgtaccggctctcgtccgacagatcgaggggcatggcagaagcactccttggtcgcggttcccacggaccgtagaggcccggggcgggccgcggaaaccttcccacggtgatgtccacgaacccgcaacactgccgcaacggccgattaccgctggtcggcggagattcggcaggatgtgggcatgaccgagatccttaccccccgactcctcctccgccgctggaccgacgacgacctcgtccccctgtcggagatcaacgccgacccggaggtgatgcgctggatcggcgagggcgagaccctcgacctggacgagacggccggggagatcgagcgctgggaggaggagtgggacgaggagggcttcggggtcttcgccgtcgagctcctcggttccggcgagctcatcggcgccgtcgggctctcggtcctggagaacctcccggacgcccgtgcggacgtacagatcagctggcggctcggccgccagtactggggccagggctatgcctccgaggccgcccacgccaccttggagttcgcgctccaggaccgcggcctggaccgggtcgtcgcgatcaacaggatgagcaactcggattccgagaacgtgatccgcaagctcggcatggtgaaggaacgggacaccaccgacccccggtacgggaccgccgtacgggtccacggcatcgacctcaccgagtacgaggcctgagcaccgtcccacgatccccgcgcgggcgcatcggccgatcggtcgaccccggcgtcctccggaccgcccgcacgctccgtccgccggtcggatccgccgggggctccggcgcggtgagcatggaccggggagcggggagggcgaacccggccctccccgccccggagccgagagggacaccatgaacgcgcacgaccgactcctcctcgacggggcccgcaggggcttcgccgcggtggccgcggccctgctgctcggcgcctgcgcccagcacgcggcctccgtcccgccgggcggcccggcgccctccgccgcctccccgctgcccgccaccgcccccaccccgcaggggctgctgctgatcgccgacttcggggccgacaccgtgaccttcgtggatcccgggcgcggcgcggtcgcctcggtcgccgtgggccgggccccgtacggactcgccgtgggcgcggacggccgggcctgggtcgccaccgcccagggcgtggccgtcgtcgacacgcgcacccgcgtacggcgggccctgatcccgtaccgcaccggcaccggcccggtcaccgacggcgagtaccgcggcggcggcatgggcatcgcgctgtcgcccgacggccggcaggcttacgtgggggtcaacgtccccggcaccaccggggtcctggaggtcctcgacacggcgagcgccgaggtcaccgccgtcgtgccggtggggcggcgccccttcgacgtggacgtgtcaccggacggcaccgaggtctacgtcaccggccacgactccttcgacgtcaccgccgtggccgccggctcgctgcgcccccgccggatcgaggtcgccccctacggcaccgagggcgggctcggctcgtggctgaagccgcactacgccgtcgtacgccccgccgacgggaaactgctgctccccttcgagggcgagcggctcgccgtggtcgatccgcggaccgggcggacccggatcgaaccgatgaccgccgacacccatcagcacggcgccgccctcacggccgacggccgcctcctggtggtcggcacgggcgccgtgcggccgggcgacggccggggcccctcgctgacggtccgttccccggacggcgccgagcgggtgtacccgctccagggcccgcacgaggacgtggccgtctcccgagacggccggaccgcctacgtcacgggcggccacacccgggacggctactggaacggcgtcacggtcgtcgacctggacaccggagccacccgccggctcgcggcgggcgcccggcccctgggcatcgccgtcctctgagccgtcccccgcgcagggcgtctcagcccggcgccacggccccgccgcccgcgcggatcgcggcgagggcggcggcgtggagggcggccgggtcaccgtggtgggcccgggggctgccggtcagcgtgtaccactcgtcggcgtccttgtactggacgtcgaaccggaccagacccccggccaccaccgtggtgcgcagggtcagcgggccggtgatcacgccgacctcctcggtcatggcgccgcccggcccggcgagcacctcctcctgccaccggtccgcccgcgtcatgaggcgcaggtgtccagcatcgtggtgagcatcttcttctccgcttcggtgacggtcagcgcgtacgtggatttcacggtggtccaggcccgcccgtactggcaccagctcgccttgtccggcggctgccacaggtcggggctctggtcacccttggagcggttggaggccgcggtcacggccagcagctgaggatgggtcagatcgttggcgaaggccttgcgccgcgccgggtcccagccggccgcgcccgaacgccagccctcggcgagcggtcgtagaggctcttccagttcccggagacggccttgcactcggcgtcctgggtgaccccggtgccgtcgcgtttcaggaccacctcacgggtgtcgcacttgttgccctgctgcgcccagtgcgtgaacttgtcccggctgtaccccgccatcgtgcccaccggcgccaccttcagggccgccaactgggtccgtgcgacggcggcgctgaccataccgggcagtacgtccccaccggcgggtttggcgtcgtcacccggcgggttcggggacttcggcgaccccggcgccgccgtggacggcgagcccgcggaagcggaggccttcggatccccgccgcccggcgagcccggaccggagcacccggccgccgccgccagcagaagcgccgccagcaccgcacccggcacacgtatctgacgtcccataaccccaccccgagccggtaccgctccgcacactgtcccggaaacactacccagaaccggacaatcaacctaccgagggccctcgggcgggcgttgtcagtggctctcgctagtctcccggcataccgcagctcaggggggtcggctcccccctgtcagggctgcgcggaaccggaacgggacaggcggaggggcacggtctgatggcatggctggcggcgggcgaggggtacgagatcgccctggtggagggacgggtggcggcgaggtccgccaccgggcggacggcggggcggcagttgaagacactgcccaaggccctgaaggaccatcccgaggtggaccggctgcgcaggctggccgaatggctggaccggcacgacgcggcctgcgccgcacaggtcgacggctggatggtctcctcgctgcccgtgccgaccgaactgctcgcccgggtctggccggacgaggcctggcagagcgccctgcgcgacgtggccgtcgtcggcgacgacccggacgaggtgggcttcctgcgggacgccaccgcctccggtgagctgaaggtggtcaacctcgacggcgagaccgtacggctctccccgcgcacggtgaccctgccgcacccggtcctgctgcccgacctggacgacgtacgggacttcgcggccgagctgggcatcgtccagcgggtcgagcagatccaccgggccacctgggccaagcccgccgaggtcgccgccaccgccaccgaggtccgtgactacgcgggcggggtcttccccacccgcttcagcctcgccgcccgggccacgagcctcggctaccgggtctccggcggctacgccacctgcaaggtccgggactccggatccggtaccgaggccgccgtgtggatcggcgagccctactacgacgacgagaccaccaccggcgccctgagctggcacgacgaggacggccggacggtacccctgaccacggtcggaccggtcgcctggtccgagggaatgcggatggccgcggcgctctacgccgggcgcaagatcgaggagggcggggacgcgtgagcacccaccaggaagacgcagacaccgagatgaacaacgccgaactgctgctcaaggccggcgccgtactgccgcgggacaccaccggcgccggcggcgacgtcgtggaactgaccgcgcgctcctaccgccaccccggcctcggcgacgaccgggtcgtggtccggctcgcccccggcgaactgggcgcggccgaggacctcgccgcaggcttcctggggctcgtacgggacgaggacgagccgcccgtcgtcggcctgagccggcgccaggcactcggcttccccgagtgggtgctcgtgcaccaccccgaggacggccaccacgccctcgccgtcgtccccgaactcgaccggatcgcccggcaggccaagaccaagcccaaggccgccctcgacgcctgcgtcgaactggccggccgcctcgccgcgtccgtcccgcacttcctgcccctcttccacgagcaggccgcgcgcgtcttcctcgccgtcgagaacaccacctacgccgcccagctgttcggccgcgcccgcgccgccgaagcccagtacggactggacatcgacgaggaccgcctcgacgccgtcttcctcgaattcgccctcgtcggcgccctcccggtgaaggtcctcaccggctacggcaaggccctcgccggccgcgtcacccccgccgaggcctacgagcgcttccgccgcctgtgcgtacgccgcaccgccggcggactgccgccctccgcccaggccgccgccgaactgcgccgcctcgcccgcgccgcgggcctgaccggtaccgaacccgagcaggactacctcgccgaactgctgcccctgcccgccaccctgcgcgccgcgctcggctggtggaaggcccaccgcggcgccctcgtcgcactcgcccgccgggtacccgccgtccgcggcacgctcctcgggctgaccccgccgagcggcgacggcggcgagttcaccaccctgtggctggaggtcctggaggagtcgggcgccaccgccggactcaccgacgcggacctgcccgccgagcagcgctgcgccgacggcacggccggctggctcgagcgcttccacgccgcccgccactccggctggggccggcgccccaccctcccgctcctcctcgacctcgccgagcgctgcgccgaccggctgcgcgccgaactcgacgggccccagagagagacgggcctgcgggtcggcgtcgaggacaccgacctcctcgacctgctcctcgccctggacatcccggtcgccgaccccgagaccgagggccggcgccaccgctacgaccacttcaacctgtccgagtgggccgacggcgaccagcgccgcgacctgctcgccctcgccgccgaccagcgcttccaccccgccttccgccgcgccctgagcagcctgggcgacggctgtgccgacgtcgtccggtgcgtcgccgcctcgcctggcggccgcccgctgctggccgcgtggatgcgcgacatcgcccttgcctccaccgcagccggtctgcccggagtccccgacgccatcgcacggctgcgctggctgcccaccgaagcgctcgaactcgcccccgaggaagtggccgccgccgcggccgcggacctcgccgagaccctcgcccgtaccctgcgcggaggcctcttcgaggagctggcctggccctcctgggaggaggccctcgccgaactggcacccggccagggccgggaggccctgaacgtggtggaggcatggccgtacctgatcgtcgccaaccggacccaggtccgggtcatcgacgccgagtccaccgtcctcacgcacgacctgcgggtgccgaccgggacctcgtacaactacggcttccactacgtcgacggtgaactgctcgtcctctggtcctcctggagcagcagcgggacgcagggctactggcaccactcgcccggcgacgtcctcaccctggacaccgaccgcaaccactggtcgctgcgcagcgaccacctctccctgccgctccccggcggcgggcgcaccaccggcggcggcgtcctgcaccgcggcgacacgaagctgccggaggagcggcccctgctgtccgacggcacctcgtactgggtgtggcagcgccgtgaccagaacgaggacaccggctggctggagtacgaccccgtcggcgggacctacgggcggccctccctgcccgcgttcttcgccgacgcgctgagcgccgacgccggcaccggccgccgcggcggatactcccaccggctgcggccgacgcccaccgtggccggctcggtgctcggcgagaccaccgaaggcctgctcggctggcgcaccgtgagcgtccccggccacggctgggagggcaccgacaccggcggccgtaccgtcaccgtgcccgagggccacgacatgcccgtcgccgccctcgtcttccccggcgacgaccgtccccgcgcactgtcccagcaatggcgggagctcagcatcaccgacccggacggcgtgctcaccgcccggacgcgcgacggccacaaccgccgctccgccttcggcacgggcagcgtgcaccttccgccgctcacgcactggtacgccctgcgcccccgcgacaccgagggctcggccgtcctgcgcaccgccgaccgggagaccgtggccgcactgctcaagacggccgccgcggccgacaaggccgccgacctgcccgacctggtgaccgcggccctgccgcagatcaccgcccccgagatcatcgccggcatcgtcgagatcctccgcttcaccctcacccagcagaaggccctggacgacatcgcggcccggctccaccccgacaacacccccgaaccggaacgcgagcagggccccggcgaccggctgatcgccgacggcctcagcggcctcatcggctccggctactaccgctggaacggcgagagcgacgccgcccaccacacgctgagcgaactcggcgccgcccgcgcgcggaccgacaccgccccggtgcccggcctgctgcacttcgacacgcccgcgctcccgtactggtccttcacgtggacgccgctgctggaccagcccgcggccgtcgcgtaccgcgccgtcaccgtcgcacccaccgacgaggaacgggaggcactgctcaccctgctcggcaccatcgacgccctcggcctggcctccgccgaaggctccgccgaccgctggcgccgggtactgctccgcctcgaccagcagcacctgtccaccccggacggcgaacgcaacgtccaccaccgcagtctgctgccgctgggcggcggagccgtcctcgcactgaccgagcacagcgagtccgtgcccgatggccacgagttcggcgccctgctgtacgaccccaccggccggttcaccgtccccggcccctacaccgtgcgcggcgacgcccccctgggcgaccgcgaacgcggcgccgggtggctgaccgccctcctgggtgcggccgccgagcacggacccgtccccttccgccccgaagccgcggaggagttcgcccggctcaccggagtctccggcgccctcgcccgcctggtactcgccggactcccggccgtcgacagctacgagcgcaacttcctgacccccgagctgcgcaccgccctcggcgtcaaggccaccgacgccgcgtacgcccgcgacgagctcaaggggctcgacaccgagctgcggcgcgcgctggtcgccgccctcctgcccgccgatccggcgaagctgtggagcgacggccccgacgtcgccgccgccgcggagctctggaaccggcgcgtgggcaggcgtaccgccgtacccgactggctggccacggaagccgcgcgggccgtcggcggagcctggcccgcgcaccgggccctggccgcactgctcgacccggccgcctcgcgcgagctgtccgtcgacgtgccctggacggtcaagggcgaccacgtggagcccagcgagccggccaccgacccgttcaccgggtccgtcctgaccggagccctggccatggcggcgtggctggcccaccggctgcccgccggagacaccgtacgagcggccctgccgcccgcgctgaccgccgtacgacagcggctcgccgcgcccggactcctcctggagatcgggcactacaccagccttccggacttccggaaggcggcggggacccccaccgagaccggcgagggctacgaacgctacggcgccgtcgtcatggccacccatgacaaccagcccaagcccgcactgcgcccggcgctgctggactccaccggctccgacccgtacctgccggtgctgcgcggcgacgaccagcggccctccgcggccgaggcggcactgcgcgccgcccacgacccgcggttcgccgcgctgctcgccgacccgggcgccccggcggcgggcgccgtggccgcggacggcacctggtggccgcaggacccgagccgctccgtccccgaactggtggaggaggcgggcacccggcacggcctgggcgccgacgcggccaccctctacctcatgctgctcgccatgcccgaccccaccgaccgcaacaccgcacggtggacgggctggaagccggcccgcctcaaggccgcccgcgccgaactggccaccaccgacctggtggtgagcgccggccgcagccgggccggacgctcgctgttcctgcccggcgggtgggccgacatgccctccccgacgctgccggtggagcagtggaagctcccgatgtacggcctgcgcgccggtgaccggccctcgctgggcgtgctcgtcccggccgaaccggtcgcggagctctaccgccgcgcctggcagcgggtccaggaaggcgacctgccgcgcttcgaggagctcaaggtgaagcgcacccgcgcccgccgccgctgaaccggccgtcccgggccctccgccccggacacgcccagggcgcggcgcacctgcccgcaggagcgccgcgcccccaccgccccctcccgtacaccttccagaggaccccgatgaccgtcaccgtcaccgaagaatccgcccccgccgcccggcaggtgctgcccgccgaggaacgccacgccgccgaactcgccttcctcgccgcccaggaccccggcccccgcccgcccggctgggccctgaccccgcgcgccgtcgtcaccttcgtctgcggcagcgacggagccgaactggcactgcccaagcgccgcgccggactccccgccaagctggccgtcgcgcccaagttcgtcggcgaacgcgccctcgtcgaacgctgcgtggtcaccctcgccggagagcgcggtctgctcctcaccggcgagcccggcaccgccaagtcgatgctctccgagctgctcgcggccgccgtcagcggcaccagcgccctcaccgtccagggcacggcaggcaccaccgaggacgccttccgctacggctggaactacgcgctgctgctcgcgcagggccccacctcgcaggccctggtcgactccccggtgctcgccgcgatgcgcaccggccgcgtggtccgcgtcgaggagattacccgctgcctgcccgaggtacaggacgcgctggtgtcgatcctgtccgaccggcggctcagcgtgcccgaactgaccgccaccgaggacgcggtggtctccgcggctcccggcttcaccgtcatcgccaccgccaacctgcgcgaccgcggtgtctcggagatgtccgccgccctcaagcggcgcttcaacttcgagaccgtcgccccgatcgccgacgcggacgcggaggccaccctgatccgccgccaggcggtcgccgccgtccagcgggccggcgccgccttcggggtcgacgacgccgtgctcgacgcgctcgtcaccgtcttccgtgacctgcgctccggccgctccgccgagggctgggacgtggaacgccccggcacggtcatgtccaccgccgaagccgtccaggtggcggcctccctcggggtcgcggccgcctatctgccgggcggggacgttctggacctgctgcccgggcacctgctgggcgtcgtacgcaaggacgacccggccgaccacggccggctgctcgggtactgggacgggccggtccggcgccgcgccgaggacggctcggcgatgtggcgccgcctctgggacctgcgcgggagcctgcgttgacgtacaccgacccgcgtgccgcggtcgacagcctcgccgcggcccgtgagccgtacctcatcggggtgcgccaccacagccccgcgctggccgcggtggtccccgacctgctggacgcctcgggagcggacgtcgtgtgcgtcgagctcccggcggagttccagccgtggctggagcacctcgccgacccggagacggtcgcgccggtcgccctcgcgggcacgggcgaggacggccgcctggcgttctacccgttcgcggacttctccccggagctggccgcgatccgctgggcccgcgcggccggcgcggccgtcgtctgctgcgacctcccgctggcggaccgcggttggaccgccacggccaccgggcccgcgccggagccggtgtcgcaggcgggggcggagcccggtgtctcgttcgccgacgccctcaccgccgccggtacgggccgggagggcgacgacctgtgggaccgggccgtcgaggtcctcgcaccggggtgccccccggaagcagtacgccgtgcggcgctcggcgtcggctgggcgctgcgcgcggacacgggcgccgtcccggcgacggacctggcccgcgaggcgcacatgcgcagcgtgatcaccgacgccgccgcgggcggccaccgcgtggccgcggtcatcggcgccttccacgccccggcgcttatgccgggggcggcgggcgccgaggcgacgcacgcgaacgtgcgggaccgggacggcggcggggacgccgccggtccgccgcgcaccggtacgggtacgaccccggcggatgacgccgaggcgtgcgtccccgcgcggccgggcgaccgcggccatgcgccggcggcgccccccgcgcccgccccgggcccgggggccgggcggcactccggcaaggccgccgcctccggcgccaccgcgaccacggcggccgccgcggacaccgctccggccgtcacctccttcgtgccgtactccttcgacctgctcgactcccgctccggctaccccgccgggatccgggacccccgctggcagcaggccgtcctcgaagccggcggggaccccggccgggtccgcgaggccgcctccgtcgccgtcaccgggctctgccgggagctgcgccgcgccggacacaccgcgggcaccggcgaagccgccgagaccctgcggctcgcctgcgacctcgccaccctgcgcgccctccccgcgcccggccgcggcgagctcctcgaagccgtcaccaccgtcctcggccagggcgaacccctcggccgcggccgggcgctggcccgcgccctggaggccgtgttcgtcggtaccgcccgcggccggatcaccccgcacgccccccgctccggcctcggcccctccgtcgagggcgagctcgccgcgctgcgactgccgtcccccgaggaccccgcgccccgcgagatccgcctcgacccgctgcgctccgccctcgacggccgccgcgaggtcctgttgcaacggctgctcgtgtgcggcgcctcctacggggagcccctcaccgtcgccgccaccggcgacggcaccgccctcggcaccaagtggcggctgtcctggacgccttccgtcccggcccggctggacctcgccggggtgcgcggcgtcacggccgcccaggcggccgcgggcacgctccgcgacaccgcccgacgcgccgccgccgacggcgggccgaccccggcgcaggtcctcgccgggctggccgccgccgcgcggtgcgatctgcccgagctggtcgacgtacgcctccacgaggcggccaccgccctgccgcagaccgccaccctgcccgaactcctcgacgccctcgacctcctggaggccctccaccgcggccatctgcccggcacctccgacgcgtcccgggccgcctccgccgacctcgccggggacctcctcgaagcggccgtgcgctgcctgcccggcctcgccggcagcgaggaccccgccgacgcggccgccctcgtggcgctcgcggaccgggccgccgcccaccacctgggcctgcgtacggacgacgccctcgccgccctggccgactccggatccccgctgatgcagggcgcggccctggccgtgcgggtcctcctcgacctcgatccggccgccgggctcggcggccgcgccgccggatggatcgacggcgcgggcaccgccgacagcaggcgcgccctgacccggcggctcggcggactcctcaccgccgccgggcccctgctgcagtcctccccggccgccctcaccccgctcctggaccgcgtcgagcacctcgccgaccaggacttcctggaccggctcccggccctgcgcggaggtttcgacgccctcgcgcccgccgcccgcgaccggctgctcgacaccgtcaccgagcggctcggcgaccggatcgacctcgcactcgaagcgtcacccgccctgctggccctgtgggccgccgcggacgccgccggtctcgccgcgctcaaggcccttccgctgcccgcggcaccgtctgcgccgacgccggtccccgacgccgccgcgcggaccacgcccggcacgcccgccccgcggcccgcgggtgaacggctcgcccccgccgaccgctggcggctgctgctcggccgtgaacgcgaccggctccccgccggcgcccgccgctacgcccacgcgctggacgagctgtacggtgccgggcgcggcgaaggcgcctccgacctcgacctcggccaggggcgcggccagggcggcggccaggaggcctccttccccaccgcccgggagtggtcgcaggagctggaggcgctgttcggcgcagacgtacgggaggaggtgctggcgggagcggccgaagcgggccgcaccgacgtcctcacccagctcgatccggcgtccgtacggccctccgtggaactgctgagctccgtactgtccctcgccggcggtatgccggaggcccaactcgcccggctgcgccccctggtgcgcaggctcgtcgacgaactcgccaaggagctcgccacccggctgcgcccggccctctccggcctcgccaccccgcgccccacccgacggcccggcggcaagctcgacctggcccgtaccctgcgcgccaatctcgcgcacacccggcgccgggccgacggcggcgtggtcgtcgtccccgagcggccggtcttcagcacccgggcgagccgcgaggccgactggcggctgatcctggtcgtcgacgtctccggctccatggaggcctccgtcatctggtcggcgctgacggcggcggtgctgggcggcgtaccgaccctgtccacgcacttcctcgccttctccacccaggtcgtggacctcaccgaccgggtcgaggacccgctctcgctgctgctggaggtccgggtcggcggcggcacgcacatcgccgccggtctcgcgcacgcccgctccctgatcaccgtaccgagccgcaccctcgtcgtcgtggtcagcgacttcgaggagggcgcgccgatcggcgggctcctcggcgaggtccgcgcgctggccgcctcgggcgcccacctgatgggctgcgccgcactcgacgacgaggggacgccccggtactcggtcccggtcgcgcggcaactcgtggcggccggcatgcccgtggccgccctcagtcccctcgccctcgcccgctgggtgggcgaccgcctccgaggagagtcccgttgagcaccgaactgccacccgtagcccccgaggtgctcgccgaagccgtcgagaacctcaccccccgcctgcgcaagaagctcgacgccgccacggagggctgcgcggcgggcgccgtcctcgaggccgacggcaccgtcaccctccgcttcggcgaggacgcactcgtcaccctgcgccccggccccgcgggcacgatcaccacggcggaacaggccgtgtgcggctgcctgctggcaccccgctgcctgcaccgggccgcagccctgggcgcggccccgctcgcggacatcccgccggagccggtggcggggccggagtccgccacggcggccgggccggccggtcccaccgggtccggctccgcggaaccggtcgcccccgccgatcccgccgtgtccgtcgaccgcacggagccctccgagagcaccgcgcccgccgagacggcggcgcccgtggagacgaccgcgccggtcctcaccgcggcccaggcgcgggccgccggcgccctctggcacgtggccgccgaagccctcgccgccggggtcaccgccgggggagcggtggtccaggccgagttgctgcgcgccgcccacaccgcccgcctcgccgggctcccgcgcgccgaagccgccgccctccgggtcgtacgagggctgcgcgccgcccgcgaacgccgggccgaccagcggctcggcgacctgaccggcgccttccgcgagctcctccacacggccggcatgctggcctccggcgccgccgaccccgcgctgaccggcaccgcccgccgctcctacgctcccggcggcagcctccaggtgcacggtctgtgccgggaacccgtgctgtccgccaccggctacggcggagtggtcacccacctgctggggcccggcggcaccccctactcggtctccgacgtccgtcccggcggcctggcccgcgcccgcggcgccggttccgcctccgtcgccctcggcggcgccaccctcgaccatgcgggtctcgcccgcggcggcctgcgcatcgtcggcgcgaccgtctccccggaaggccggctcggtgccggacgcggggtcagggcgaccccgctgcccggcctcgcctggaccgaacagcccgcggcgcggctcttcgcccgcccggccgccgaagccgtcgccgagctgctcgccgatcccgagggggccgagtccgcgctgctcgggtgcgatgtcatggtcgtcggcgccgccggcgaacacctcctcgtgcgcgagacgcgcccggacgcgccgctgctgcggctgctgcccgcgcatccgcacccggagctggcgcacacggagaacctgcgccgcatcgcctcgtaccccgggctcgtgctgcgcgtcctgggccgccccgacctggaccgcacggccacgctccgcccgctcgccgtcggcccggtgccgggcgcggagtacacgctgcggctgcccgaggagtggctgggccgggccgacctcggctacgaccggctccagggcgcgcacttcccacagggggacgcggcccccgtaccgcttcaggcggccgagggtccggatccgctggccgactccccgctgtggcgggtacgccgcctcctggagaccggggtcgccgggggccggcgcgccgtggccgaggcggcccgcggcacggcatccctggccgcggcctcgtacggaccgctgcgccgggccgggctcaccgcggcggcggacctggccgccgcactggccgccgaggccgaccgccgtccccgcgacgtcttcggccggctggccgacccgtcgtccgacggctacgcctgggcctggctggccgccgccatccacctcgcggcggcggaacgctgcttgatcgccgcgtcctgggcggcgatcccgggccccgtcccgggccccgtcccggtcagcgggcggtaacggacggcgtcagtgtgcgggccaggaggtccagggccgcggtgacctcgcgaacggtctccgggtccggcggcgttccgccgggaccggcgagggccgcggcgagagcgtcgtcgatggtggcggcccgcacttccgcgacccgggcggagggctcggcggcgggccggatgaggcggcggcgccggtcggcggggtcgggctcggtgtcgaccgagccggcctgctccagccgggcgacagaggtggagacctgactctgcggcaggcccgtccgtgcggcgatctcgccgaccgtggttccggggtgggagacgacgtcgccgaggacgacgaccaccgagcggaccgatcccgtcggtcccgacttcggctgcggcatcgcctgttcgccgatcttcatgagggcgcgtcccaggaggaacgcttcgactccgttcatgaacagcagagtacatctcaatagatgcatctatcttgatgcatctattgagatggattactgtcgtgtcgtcagccggagataccgatgacacgccagcaagggggatccgtcatgcccacgaccgccgcttccaccaccacccgcaccctcgacgtcccgggcgccaccctgcacttccaggtcgagggcggcggccccgtcctcctcctgtcccagagcggtgagggcgacgcggaccgcaccgtcgacctcgttccgcacctgaccgacaccttcacggtcgtcacctacgaccgccgcggcctgtcgcgcagcaccctccacgaccccgcccggcccgtcaccatggccgaccacgccgacgacgtcgccaggctgctcgccgaggtcaccgaccggccggcgctgatggccgggttcagcatgggcgccgcgatcggcctccaggccgtggcccgccaccccggcctgctgggcaccctgatcgcgcacgagcccgtgatgccgaacctgctgcccgccgcggaccgtgcggaacacctggccgagctgagggccattcaggacgtctacgcggccgagggcctgatggcggcgttcccggcgatcgcccggcacctcggcatcgacccgtcgcacgacgagacggaggacggcctcaccccccagccgctgaccccgcgccgacgggccaacttcggccacttcatcgcggcggagttcacggccgtcaccacggacgccctggatccggcggagccggtgcgggccgcggcgcgagccggaacgaggatcgtcccggcgacggggcggacgacccggcccacggtccacacctaccgctgcgcgctggcgctggcggcgcgactgggcacggagccggtcgagttccccggcggccacaacgggaacaccgcgttcccccgggcgacggcacggacgctgaagaccctcctcggccggtgaccggcattcccaggtggacggcctgcctggcctgtgagacctgggtccgagccggcggttcgtgcgccggtacgccgcgatcacaccggccacagcaagatcattgcactgtggtggaaccctccagccggtgagggtggggtccggagacgaaggcgaggatgtcgcggactgcttcgtgcaaggtgtcgaagtggcgatgcacgccgtccaccgctgcgggggtgttgacgccccacaccgtcatcccggcacgcagcccggactgcactccggagggggcgtcctcgatgaccaggcagtcctccggtcgtgcgccaagccgcgcggcggcctgcagatacggcaccggtgacggcttgccctcctccacagcggcggcgtccacgaggacttccgggaccggcaggcccgtccgggcgaaacgtccgcgtacccggtgctcatagttcgacgtcaccaacgcccaggccccgggtcgcagagcgttcagcagctccggggcaccgtcgaaagctgtataggtgccggtgcggacgtcctcgtcctccagctcgtgcagttcggccaggcacttctgagcgtcccggtccggagcgacctgagcgaaggtctccaccggcctcgtccgtagtgctacttggtagacctcatcggggtccagaccgtaccgctccgcccatgtgcgccagaccaggcgctgattgtccacggcgtcgatcaacgtgccatcgacgtcgaacaggacatacctcatcgcaccggactgaccgggttcactgatcacgcctcgatcatgccatcagggcctgagcgggccgttcgcgggacaagtctcagcgaggccgtcggccggctgacggctggctcacgcctggaccgccggtgtgcgccatctggacgtagccctcggccggcgtgggcagcgcgtcgacgcaagccgtcgaacaggcgttgaccagcaagggcaggacgtccgcgcccgacgtccagagggagatccagacctggcggaggttcgcaccctggatgcgccggtcgcagacgctgcacgtgcggatcgccgaggcaccccatacaccggggtcgaggtcttcgaggtcaaccccttggaggctggtcggcgccgcggccgacaggggcgggaacgggggccgtcgcttgtggttgccgtagacggcacgggtgctcacggtgctgtgccgcaggtcgaggcaacgggtgagctcgtacgggaaccagtgcaagcggtaggaggtgtacggggtgaactcctcaaggctcttcatcgcgccgatctcaggcgggatgcgcaccaggttgctgccgtacagcacgaggtgtttcaccgaggtgagtgtggtgatggtcggcgggagcgtgatgacctggcgccgctgttccgctgtgagctccaccagcggcttgaagacttcccgcccgtcggccgccgcctcctcgaccagttcgagaaggcggacccagcccggtgcggtggtgtcctgacgttccggatggaagccggtcggtagctgcgtcctcgtgccctgctcgatacacctgcagagatcgcgaggcgaaccctggccgctgggcccggcggcgtcggcccagcggttcgggaacacctgcggattcgattgctcactcatcggcccacagtagacgtcacaactgacgatgcgtaagcgcgatttgacgcctttgcccgggcggggcggggatcgtcggcggtggccctggatcttgatctccggcgacccgggtatgaacgatgatcttggaggacgaatggcggggtggcggacaccaggacggacatcaggacggacatcaggacggtggggaaggacgtgggcgtgatcgagcggttgtggcggtacccgatcaagtcgaccggtggcgaacggctccggcgtgtggacgtcgacgagcggggcctggtgggcgaccggctgttcgccgtgcgcgacgcggagggcaggttcggctcgggcaagaacacgcggcgattccggcggatggacggcctgctccacctgagctcccgctacccgcgcagtaccccggagccgggtccgccggagctgctcgacccgcacgggaacgcggtggccgacccgacggcgtacctgcgcacctacctcggccgggacgacgtggagctcgcccgcgagcaagagatatcgcacttcgaccaactgccgctcagcgtcctcacgacggccaccctcgactggatccgccgcgaggtgcccggtgtaccggtggacgagcgccggttccgcccgaacatcctcgtgcgtaccccgcccggtaccccgcccttcgtcgaggacgagtggatcgggcgcgaggccaccgtgggggacaccctccgcatcgcgttcgtgcgctccagcgagcggtgcgtgatgaccaaccaggcccagcgggacctgccgcactccccgctggtcctgcggacgatcgccagggcgcacgacaaccggctcgacgcgctcgcgcggatcgtcaccccgggaacggcccgggtcggggaccgcgtcgtgctcgcctgagcgagccggcgcgcccgagcccggccgggccggacggcgtcaggagcgatccagccggctcacgagccctttttccgtaccggagcccctgggacggaacccaggtccccgcgatcgcctcttggtggccagaaggggggacggccatgacgaagacagcggtgtccgtgaccgggcgactggtggtggcggggctcctgtgcgccgccctcgcggggtgcgggaccacacggacggggcaggcggcgccgcccgcgggcgtaccgacgctcgtccgggcggagtgcgatctcgacgtgccgaccgatgaggagacgggcgggtacgcgggtccgccgaccgatcaggagaccggggcgtacgcgggtccgcccaccgatcaggagacgggggcgtacgccggtccgcccaccgatgaggagacgggcgggtatgccggtccgccgacggaccaggagacgggcgggtacgcgggtccgccgaccgacggcgagatgaccgacggcggtggcccctgcggcccggcggactggttcgacatgacccgcgacttcaccgcctactacgtcaagcacgcggccgacgacggctacgcgggatccgaggagctcaaggaggtccgcgtccgcaaggtgcgcaccgtcggcgaggccaggatcaccttcaccaccagggaagtgggcaagggccgcggcgacgccgcccgctcgatcgcggcgctgttcgccgcctggcggcacgaggtctacggcgacacgggcacgctgacgctccggaccgcgacgggtgcgcggctggacgtcaccgcgtcctggtgaccccgggccaccgcgcgtcccacagcgcgcagtggtgctccgcccgcgcgtccaccgtacggatcccgtccgcccccggcgccagcgagagcgccgaggccgacgtccccccgcgcggccaccgcggtgctcccggcgccgccggaacacccgtgcgggcgaagccggtccagtagccggtcatccggtccgcgagccgccgctgcggtccggtcagcggcgcgatcgtgaacaggtagggcagttcgaagccgtgggccgcgccgtacggcaggtccggcggctccggtaggcccgtgaagttcggcgcgccccggtcgctgaaccggtacgcgtacaccggcacgtgccggcccagcgccgcgccgtcccgcagcgtcgggcaggcgaacgacgcgtcggtcagtacggtggcccacgccaccgccggggtcgcgaaggcggacaccggatacgcggcctccaccgcccgggcggtcggtgcgtcgaaggaccgcaacagccgggcccggtaggcggccccgtcggggatcggatacacggccagggtctgggcgaggaagaggcgcatctcgtcctggtcggtgccctggacgaccggcacccggtggaaccggccggcctccagcgcccgccggggctccatcggcagcacgccgttgccgtacgcgaccagggagaagcgctgcatcagttcgggggtcgccaggacggccgggtccagagcccgcaggcagtccagcaccccgccgggccggtcgcagccgagccgggccgccgccagggcgccgtcctcgaccgtgcggcgctccggtacgaagggctcgtacgtgccgaggccgggcagcagggagcgcggcggcgccgtggtcgagcaggatccgctctgcacgatcgcccggtggaacaggcccgccgaggcgggcgacgtcaggtgcgcgcagacgctgagagccccggccgactccccgaacacggtgacgtcgcccgggttcccgccgaaccgcgccgcgttcgcccgcacccagagcagcgccgcccgctggtccgcgagggcgaatccgggtgccccgccgagctccggatggccgaacaggccgaagacccccagccggtagttcacggtcacgaccacgaccccgccctgcgtggccagccgctcgggccggtaggcgtcgcccgagccgctgaagaagccgccgccgtggaaccagaccatgacgggccgtccccggcccccggcggcggcccggcccgccggagcggtgacgttgaggtacaggcagtcctccgagccggtcggcccgcccgccccgacggcgggcagctgcacacagcgcgaaccgggcgccccggcatcgcgtacgccctcccagcggggcgccggctccggcagccgccagcgcagcggcccggtcgggggcgcggcgaacgggatcccctcgaaggtgtcgtaggcgccgtgcccgaggccccgtaccggcccccggtccgtgtcgaccacgggccggtccgcggcgggcgcggcgcccagcagcagcgacacggcgggcagcagcagtgcccaacggcgaaggaaccggcgaaagtcggacacggccgacgccctttcccctgcggggcccgcgcggagcccccccgtttgcccgccccgaatggcgcagtgggcggaagtggcactcaatgtaacaaagcgtgcgcttcccatgacgcacgatgaccggcgcgcgattgcgtagacccgcgcgtcggcgaacggagctttccatgaatgaccccatcaccctcgcggcgaaacagcacgaagaccgccacgggacccccgaccccaccgcaccggacgagccgaccacgccgcccatgcggaccctgctggagacggcggcgacctgccgtccggtcgaggaggtcacggcgctcgtgagcctcctcaaggagggcggcccgctgcccgacgccggacacgacgccctgcgcacggcagccgtcacccgaccggtgcaggacgtacgacggatggtcgccctgctgggcgagtcgccccaggaggtggccgaggcggacctcacgctgcgggccgccgccgtcggacggtccatcgaggacgtcgccctgctggtgaccatcctcggcaaggaggacgcggccgaggcggagcgccggggccgcgccgggcccgccgccccggccggcccgtacggcctgcccgcggagccccacgcggagcccgacgacgcgaagtacgcggagcccggccggccgcgccacccggagccgaacgacgccccgtaccaggagcggccccggcacaccgctgctgccgtcgcggagcccgccgcctcccgcgaccgggcactgcggcgcgccctgcgctggcccgtggcgatcgccctgctggtcagcggcgccctgcacctgccgaacgacctgacggccctgcagttcgcggcccccgtcgacggcctgcccctcctcgtcaccgtgctctgcctggtgagcggcgcgctcgtggcgctccgggacaccgcgacggtgtggcgggcgggcgcggtcaccgccctcggcgtcgtcgccctgcacgtgctgggcgggtcgctgcggtacgaccccctggagggcgcggtgggcggcaccctggcctgggccggtgtcaccgtcgtgctgtgcgcggcggtcggcgcggtcctctccgggctggccctgcggaaccgccgggcgccctcggcctgaccggccgccggctccacgtgcggcaccccgcgccccgtgcgcggggtgccgctccgttcgccgtcgggcccgcggccgggcagggcggcgcggtcacgcgagcaggttcaccgccccggtgaacacccgggggagccgggcggccagcgggacgatccgtggagcgagccgcggctggtgacgggcccacagcagggacgcggtgagcgtgcggtagctgcgtgacaggtcccgccaggcctgctcgtaggcctgcggacgccccgcccggacgcaccgcaccagctcgcccgccgccgtcacggccagggtgagcccctcaccggtcagcgcgtccacgtacccggccgcgtcccccacgaacagcacgcgccccgccacccgtacgcgagccccctggcgcagcggcccggccccgcgcaccggcgttcccgccgccgcggccagacgcttcgacagcaccgggaagcgggccagctgtacgtcgaacggggcctggtcggaggtcaggacggccacgccgatccggtcgggcgccagcggggtgacgtaggcctcgctccgcgccgaccagtgcacctcgacgaggtcgctccacggctcgacggcgtagtggcggcgcagcccgtagcgggccggccggcggggcgcggccggcgccgacaggccgagcccgcgccggacgggggagtgcaggccgtccgccgcgaccaggtagcgggcggtgagccccgccgcgccgacccggtcgacgtcctggcgtacctggtcgacgcgcccggggagcacccgtacgccgagctgtgcggcccgttcggccagtgcggcctgcagcgcggtgcgccgggcgccgaggcccgggccggaccggaagcgtccctcggcgtggcggccgctcacgccgtcgaggtagcggatgccgtggaacggctgcccggtgacggcgacgcccagctcccggaggcggcgtacgccccccggcatcaggccctccccgcaggccttgtcgatgggggtgggcctcggctccacgaccacggcctccaggccggcgagcgcgccgtggatggcggtggccagcccggccgggccgccgcccgcgatcagcaggtcgatcacgaggcggcgccggccgaatggacggaggcgggggcccgcagccggccgccgtcggtgagggcggcgtcctcgcagccgatccgcacccgcagcagcatcagattgagcacggtgaagccgagcgccgtcatccacgcgctgtgcaccagcggcagcgcgattccctccgcgaccaccgccacgtagttcgggtggcgcagcagccggtacggtcccgcctccaccagcggcagtccgggcacgacgagcacccgggtgttccagcgcttcccgagcgtggcgatgcaccaccagcgaaggccctgggcggccagggcgacggcgagggccgaccagccgagcagggggacgaacggccgcccggccgcccagggttccaccacgcagcccacgagcagcgcggtgtgcagggcgaccatggccgggtagtggccgcggccgtactcgcggccgccgcgggccaggctccacgcggtgtggcggcgggccgtgatcagttcggcgagccgctcggcggcgacgaggccgatgagcaccaggtacggggtcagtgcgggggaggccgaggcggaagcggcggcggaggaggtcacggcggggaacgggatcatcggggtcaccagcgcaggaggacgagttcggaggcgaagcccgggccgaagccgagcatcagcccgaccgatccgggcgggggcgggcccgcgctctggacgccgtccaggatgtgcaggaccgaggcggaggagaggttgcccacggccgcgagcgagcgccggctcgcggcgaaggccgactcaggcagtgcgagggcgtccgagagcgtgtcgaggatcttcgggccgccgggatggcagatccaggcgtcgacgtccgcgggcttgaggtcgtgcgcggcgaggaaggactcgacctcctcggccacgtgcagcctgaccaggtcggggagttcgcggccgagcaccatgcgcatcccccagtggccgatgtcccagccgaggaggtgctcggtgcccgggtacaggcggctgcgggcggccaccacctcgggcccggcgccggtggcgtgcaggggatggtcgcgacccaccgccaccaaggcgcccgcgccgtcgccgaagagggccccggccaccaggttcgccatcgaggcgtcggtggactggagggtgagcgagcagagctcggtggacagcagcagggccgcgtggccggaacggcccgtcagatggtcgtggacatggcccactccggcggcgccggccgcgcagcccaggccgaagagcggtacgcgccgtacgtcgggacgcaggcccgcgcgggtggcgaggcgggcctccagcgagggcgtcgcgagcccggtcaccgtggtcgacatgaccagatcgacctcgtcggccgccagtccggcgtctccgagggcgagttcgagggcccgggcaccgagctccagagccgtctcgatgaagagggcgttcgtcgcgccgaagtcgttccccgggccgtaccgctccagcggcagcgcgagatgtcggccgtccacccgcaccgagccgtggatgcggcgcagcagggtggcgtcggagcccggtggcaggaagcgggccagcgcctccgcgatctcggactgggggtggtgatgaggtgggaacacgctgcgcactgcgagaacacgtgtcattcgttcaccatagaaaacaactgacacatcgtaatgaatcaggcgaaccgggcgcggcgccgcatagcgtgtcgccgtgcccgcacgaaccacgcagatccacgacaacgcccgagccaccgggagcgcggcgtccggcgccgccgccgtacgcggcctggccggcgcgtgccacccgctgcccgcggccgccgtgaccgtcttcgccgcggccctgacggcggccgcggggcaggctccggcgcgggcggccgtcaccgtgggcgcggtggccgccggacagttgtcggtcggctggtgcaacgaccgggccgacctgcggcgcgacctggccacgggccggcaggacaaaccgctcgccgccggtacggtgtcgcccgcggccgtgaccggggccgcggccgtggcgctgctgttgtgcgtgccgctgtccctcgcctgcggaccgttcgccggggccgcgcacctcgtcggcgtggcggccgcctgggcctacaacctgaggctgaagcgcacggccgcctcctggatcccgtacgccctggcgttcggcctgctgcccgccttcgtcaccctgggcctgcccggcgccccctggccacccccgtggctcacggccgccgcggccctcctcggtgcgggcgcgcatttcgccaacgtactgcccgacatcgaggacgacctggccaccggcgtgaccgggctgccgcagcggctcggccggcccgtctcggccgcgctggccgggctgctcgtcctcggctcgaccgccaccctggtcgtgggaccaccggggcgggtgacggcgtacggctggttgctgctcgcggcgaccgcggcggcgctgctcctcgcggcccgccggcccgccggaaggctcccgttcctggccacgatggcggtggccggagccgatgtgatcctgctggtcgtcgagctccgcccctgagccgcgaggccccgcggacgcggtacccgcgacacgaggccggcgccgggacgggcttcagggcatctcccgggtgcgggtccaggccaggaccgtgtccgccggccaggtgttgatcacgcgcccggccgggaccccgcactccacggctctttcgcagccgacgatctgccagtccagctggcccggggcgtgcgcgtccgtgtcgatcgcgaagaaggtgccggccgccacggcgaggcgcagcagccgccgcggcgggtccagccgctcgggccggctgttgatctccacggcggtgccgctctccgcgcaggccgcgaagaccgcctcggcgtcgaactgcgactgcggccgggtccggccggtgaccagccgccccgtgcagtggcccaggacgtccatcagcgggttgcgtacggccgccagcagccgtcgcgtcatcgccggcgagtccatccgcagtttcgagtgcacggaggcgaccaccaggtcgagctgttccagcagctccggttcctggtccagggccccgtcgtcgaggatgtcgcactcgatcccggtcagcagccggaagggggcccaggtctcgttgagctcggccaccacccggagctgctcgcgcaaccgctccggggagagcccgcgggcgacggtcagccggggcgagtggtcggtcagtacggcccactcgtggcccagcgaggccgcggcccggcccatcgcctcgatcgggctgccaccgtcggaccagtccgagtgcacgtggcagtccccgcgcagggccgcccgcagggcggtggcggcgggcgtggccggcgggccctcggggagcgcggcgatctcgtcctccagcgcctgcagataggccgggacggccccgcccagcgcttcccgcacgacctgggccgtcttggggccgaggcccttcacggcctccagggaaccggccgcgacccgctcggccacctcgccctcgcccatccgggtgacgacggccgccgcggagcggaaggcccgtacccgataggtgggggcctgggcgcgttccagcaggaaggcgatccggtccagcgccgcaaccgggtccatcgcgcacctcctgcccgccgcccctccaccgtcacccggtccagtgtccggtgcgggaggcggctacgcctctccggcctcccggggcacggcggcgtcgagggcggcggtgaggcggttcaggcgggcctggaggtcgaggacctcggtgagctcgaagcccgtcgcggccgcgatccgccggggcacctccaccgcgcggacgcgcagcgcggcgccctcctcggtgaggtgggcgtgcacggaacgctcgtcctcggtgctgcgctcgcggcgcaccagtccggccgcctccagccgtttgagcagcggggacagggttccggagtccagtcgcaggtgctgcccgatctccttgaccggcatctcgccgtgttcccagagcaccagcatcaccaggtactgggggtaggtgagccccaggtccttgaggacgacgcggtagaggccgccgaaagcacggctcgccgcgttcagcgcgaagcagatctggccgtcgaggcgcaggaagtcctggtcggcgtgggtcgcggtgggctgctcggtcatgacgcccagtgtacccggagtggacttgcgaggcattgaattgtgcacaactgaattgtgtgctctagtagtggagcgcggtcgacaccggccgccaccacggttcatttctgcgagaggacctctcatggacgcgctctacaccgctgtcgccaccgccaacggccgcgagggccgcaccgtcagctccgacggccagctcgacctcgccctcgcgatgcccccggcgctcggcggcaacgggcagggcaccaaccccgagcagctcttcgcggccggctacgcggcctgcttcgccagcgccctcggcctggtcggccgccaggccaaggccgacaccagcgaggtctcggtcaccgccgaggtctccatcggcaaggacggcgccggcttcggcctcggcgtcaccctgcgcgtcgagctcccggagtccctggccggcgagacgggcgccctgctggtcaagcaggcccacgaggtctgcccgtactcccgcgccacccgcggcaacatcgacgtggacctcgtgatcgagtaaggatgccggacaccgggcgggcggccaccatggaggagcatccactcctccgggggccgcacgccaggaggcgcccatggcgcacacccacccgaccgacgtcctggtcgtcggcgcgggcccggtcggcctgaccgccgcggtggagctgcgccggcgcggtgtctcctgccggatcgtcgaccggctgcccgccaggctgccgttcgcgaaggccgtgggcatccagccgcgcaccttcgaggtctgggaccgcatggggctggcccgcaccgcactggaggcggccgtcccgatgcgggggcagttcctctacgtcaacggcgccgagcagccccgtaccgagctctccgtcccgcccgacgtgccctacggattcgcggcgctgccgcagtacgagaccgagcgcatcctggacgagttcctgggccgcttcggaacggccgtcgaacgcggcaccgagctggtgtcgttcagccaggacgccgacggggtgacctgccggctgcacggctcgtccggggcggaggaagagctgcggacccgcttcctggtgggctgcgacggcgcccacagcatcgtccgcaagggactcggcctcaccttcgagggcggggccttcgcggaggagtacatgctcgccgacgtacgcgtcgactgggacctgccgcacgagtacaccgtgcgctccatgcaccgcgacggtgacggggcggtcgacgacgtgctcgtctgcattccgctgcccgggcggggccggtaccggatgtcgatgatggtgccgcccgaactctccaccgcacagcaggacacggccgccgccgacggcgtcgcccacggcctgcagaacggccggggcccgggcctggccgacatccagaccgtcctggaccggctctcaccgaagccgaccaccgccttcgacatccgctggacctccgtgttccgcatcagccaccggatcgtggaccgctacggcgacggcagggtcttcgtcgccggggacgcggcccacatccaccccccgaccggcgcccagggcatgaacaccggtatccaggacgcctggaacctggcctggaagctcgcactggcctgcgagggcgcggcccaccccggactgctcgccggctacgacgccgagcgccggcccgtcggcgaggaagtcgtcggccggaccgtgcggcacgccgtcgagggaatggagaacgaccccgacgacccggcgacgctgatgatgcgcgaagcccagctcctcgtcggctaccggggaagcccggccgtggccccggccggcgagggccgtggcccccgccccggcgaccgggcacccgactgcacgggcctcaccgggtccgtccacacctacccgatgcgcctgtacgacgtcctgcgcgagcgggaccacgtactgctgctgtacggggccgggttcggctccggttcgggcctcgacgaactcgtacggacggcccgggagtcctcgggcggccggatggacgtctgcgtggtccgcgcggcggatgccggcaacggcaacgacgccggtaccgatgcgggcgccatggccgaggcggacggcactgtgctgccggtctacgccgacacccggggcgagttcgcccgcctctacgcggccgaggagcccacggccttcgtgatccgcccggacggatacctcggcgcccggttcccgctcgccccgcccgcccccggaccgctggccgcccatctggccgccgtcttcgccccggatgcccccgcgcacacccgggactgatccgtcaggcgccggtgcccgcggcggcctcccggcgctgccgcttgcccagcggcgccagcgacatgtcctgggcctgcgacttcagctgcttgaagccgtacccgcgctcgaccagccagctctccgccgccagctccgcacgggccgtcgcgtccaggatgtcctcctcggcctcacccgtgtccacgaagcggaaggtgaagaaggggcgggccgagacgtcgtacgacagatgcccctcggcggtgaactccgcgcgcagcaggtcgtgctcgggcgcggcggcgagcagctcggccctctggccgtcggtcagaccgtcgaaagagccgcggacggtgatgcggaaggtacgggtagcactcatccccgcagcctaggacgggcgccgcgtcccatgcacccggatatccgccggtccgccccgcccaccaccccgcagacggccggcgcaaggccgcgcacaccgcacggacaccccgaaagccccggccgggagcccgttttggattgccggacgatcctcaatacgatccggcgatgatcacaagaaaacggcttgcggtcggggcgtgcggcctgctcgccgccctggccgtcgggctcttcccggcgagcgccaccgccgccgacgaaccgacggcgaaggaaccccccaaggtcgacctcgtcctcgacgtcagcggctccatgcgggccaacgacatcgacggacagacccgcatggccgcggccaagcaggccttcaacgaggtcatcgacgcggtcccggccgaggtgcgcctcggcatacggaccctgggggccgactacccgggggacgaccgggccacgggctgcaaggacaccaagcagctctacgcggtcggccccctcgaccggaccgaggcgaagaccgcggtggcgaccctcgcccccaccggctggaccccgatcggaccggccctgctcggcgcggcccaggacctggagggcggcaacggctccaagcggatcgtgctcatcacggacggcgaggacacctgcgccccgctcgacccgtgcgaagtggcgcgcgacatcgccgccaagggcatccacctggtcatcgacaccctcggcctggtcccggacgccaagacccgggcccagctgacctgcatcgccgaggccaccggcggtacctacacctcggtgcagcacaaggccgacctctccaagcgggtgaaacaactcgtcgaccgggccgcggacccggtcgtcaacccggtggcgaccgagggcgcgaagcagtgcgagggcgccccgccgctgaaggccggcctctacagcgaccgcgagaccttcggtgaacaccgctggtaccgggtcgacgtcctgccgggccaggaactgcgcgcctcggtcagcatcggggccgaccgcgccgtcaacaacgactacggcgtcctgctgcgcgccaccaccgtccacgggcgcgagatcgtccgcggctcggaggcgggcgacggccgtaccgatgtcctctccaccggcctgcgctacccgaaggccgagatcgacggcctggactcggacgccaagcccgtaccggagaccgtctgcctccaggtcagcaactccttctccgctcccgcctccgtcaagacgaccccgggcatgcccgtcgagctgaccatcgacctggtggacggacccgacgaggcctccgacgtcgccgccttcggcctcgggcggggctggtggctgctggccgtgctggcgctcgccgggctgctggccggtctggtgtggggttggatctcccgctggcgcatctccgtctggaggaccaactgatgcgtagagtaggcacactgaccgcgtccctgctggccgcggccgccgccctcacggtggcgggcacggccgtgggcacggccgtcgctgactctccctcgccgagcgccaccgcctccgcgagcgggggcggagccaaggcggagtccgctccgaccgaggcaggcaccagcttccgtaccgcggcggcgttccgccccggccagaaggccacggccggcgcgtccagcggcgactacctctactgggtggtgccgatcgacgcgcagcagcgcgccacggtgaaggccgccgtcaccctgcccgagccggcggcccggcacggcgcctcgacctggcagctcgacgtgtacgacgggctgcgccgccggcaggcgtgcacctacggcacgcagaccgcggccgcggcgaaggaagccgccacggtcgaactgtcctgcaccctgcgcaccgtacgcgcgggcgccgagccgtgggccaacgacccgctgccggggagctactacgtacgtctgaccgccatcggccagccggacgaggacaagggcctgccgatccgcgcggcgatcgaggcggacgtcaaggagaccggcggcagtcgcgcggtggacggggcgctgtccaccccgctggtcgcgggcaccgtgacggcgaccctgcgcgagccggaggacggctggtccggcggctggtggtcggaccgctggatctggaccgccgcgggcggcgtgctcgccgccctcgcgggagtcttcgggtacaccctcacccgtggctccggccgcccgacccgggtgcccccgggcgcctgaggaacggggaggccgcggcccacgggccgcggcctcccctcacccgcccgcgattcagcggccgcgcgtcagccgggttccgaacgagggctcggccagggcgcccttgaccgccaccggcacgctcttggctccttctccgctgcccaccgtcagtacggccacctcggtaccggccttcgcggtgtgcggcagcgctccggcacccgcgccggcgccggtcgtgacggacagcttcagctgctggcccggcacgccgatcacgttcaggtccttggtggccaccaacggcgtacggccgccgagcccgtcgtccacatggcccacgacgtcgcccttgcggatcaccggagccgacgcgagcgccgtccgtaccccctcgatgatcgtcttgctgttcgccagcaccagcttcaggctgtccgcgccgtcctcgtccggcccgtccgcatgctgatccatcaacgtgccgaggaccaactggtccttgccatcgatcgacttgtacgccgcccacatcagggccccgccggcgggcgtgctggaaccggtcttgatcccccggatgctgagcccctgggaggtgagcaggatgttgttgttctcgagccgcgtggacaaccccttgatgctggcgttcgggagcgcgacgatcgaacggaacacctcgtccttcatgacggcttcggcgagcttcagctgatcgacggcggtgctgacggtgcccgagtccagaccgctggggtccgtgtacgtggtgttcgtcatcccgagctccttggcggcggcgttcatcttcgcgacgaacgcggcctcggagtcggtgccggtgtcccagcgcgccagcaggcgcgcggcgttgttgcccgaggggatcatgagcatcttgagcacgtcctgctggctgaacttctgcccgacggtcagaccctcgacgcgggactcgtggtcggctttgccgtccgccacggtcttcgcgtcgatcgtgatgtccggacccgggtcggccttgcggagcgggtggcccttgaggatcacgtaggccgtcatcaccttggcgacgctggccgtcgggacgggcttctgctccccgaacgtgccgatgtcgccggagccggagacgcgaacggcgccctggcccttggcgggccaggggacggagaactgcccgtcgagggtgcggtcggtctcggcggcgacgagctgcggggcgggcagcgggcgcagaagctgcgcgccgacgccggcgcccgcgaggaggagcaggatcggcgtccatatcttgacgcggcgcagcgcggtccggcgcggggtctccggcggggcgggggtgttggtgagctcggcgagcagatcgagcgggggcagcggtacggcgggggccgccaccgccgccttggcctcggcggcgggccgcggctgagcccgcggcgcgacgggtgcgggcaggtcgatgtccttgagcgcgacgaactggctcgtccgctcggggtccggctcaggctccggctccggcttcggctcccgcgcccaggagggcccggcggtcttctgcttgggcagggcgatgagcatcgtctcgtcggcggcggcaccggacccgcccggagcctccggctcggtcccgccgtcggcctgatcccgggcggagcgctcgcccgccccgctccgaccctcggactcgccccctgcctcttcctccggttcggagtcggccttggcgtcggcggggcccttggccgggggctcggggtcggttttgccctggggcgcggccttcgccgcggcttctgcttctgccttcggctcggagtcggccttggcgtcggcggggcccttggccgggggctcggggtcggttttgcgctggggcgcggccttcgccgcggcttctgcttctgccttcggctcggggtcggccttggcgtcggcggggtccttggccgggggctcggggtccgccgcggccttcggctcggctccgtcctcgggcgcggcctgcgccgccgcctctgcctcgggtgtgtcgtcggtctcgacgcgggctgcttcgggttcggtcctgccctcggggcccgtgtcggcctccgggtcggcttcgccgtcgggctcggcgtcggccgcggccttcggctcggcttccgcctcaggcgcggcgttcgctgccgccttcgccttgggctcggtgcgggcctcgatctcggcttcgggctcgacgtcggccgccgccttcggttcggcttcgggctcgggggcggtgtccgctgccgcctccggctcgggcctggttccggcgcgcgggtcggcttcggggacggccgcggtccgcgggccgttctccggggcggctgccgccggtgcggcttcggccgcggaacgggcctcactcgggagttcgcccccggccttcgctcctgcctccggctggggctcgtcttcgagccggcggcgcgcgggttcggcctcggcgtcacgggcgggccggggggcggtgtcgccctcgggctccgggtctgcctcgggcgtgggttcgggctcggccttcggctgcgccgtcaccgcgtccgaggggccggatccggcccgggcgtcggccgccgaaccggtcgcgtcgtccgagtccgagtccgtgtccgtggcctccggctccacccgcccctcggcgtcggcctcggccgccacctcgggcgtcccctccacgacggtggtctctgcctcgatctccggctcgtctgaggaaccgcccgccaccgttaccgccttcatcccagccccgccttgctgctcacaccatgccgatacgaccggcgagacccccgcggagccccaccgcaccgctagatgtccccgtcgttccgctcgttccgtgccctggatcttgtgaccgttcggtcatattcgctgagtacgcctactcatgacccggcctgccgcaccggccgaccatgggccacaacgcaccgcgccaccgccgcgccatccgaacggggtcgtccatgctcagccgaatcgccgccgccctcgtgcccgccttcgggcggctgaccgtcaccgccgaccccggggcgcgccccgcacccggcgccatcctggtcgccaaccacacctccctcgccgacccggccctcgtcgtcgccgcactgcgccggtacgggatcgagccggtcatcctggccaccagtggcctctggcgggtgccgctgctcggctccgcgctccgccgcgacggccatatcgccgtgcaccgcggcaccgcccgcgcggcggattccctcgacgccgcggccgtcgccctcgcctcgggccgcagcgtgctgctctacggcgaaggccggctgcccctgcgccgcgacgcgggggagacggctcccggccccttccgcagcggcctggcccggctcgccgccgcgacgggcgctccggtcgtgcccgtcggccaggcgggtgcccgccgcctgtgctcggggagcggcgccaagcagctcgccggcgtcttcaccgccccgctgcgcaggcccggcttccacgtccacatcggctcgccgctgtacctgcccgaccgggtgccggaggccacggaccgggcccgtcaggccgtcaccgcagcctggcggacggcggcgtacgccctgggggagacggggcgggagacgatctgagcgccccgcgggacgccgatcgggcccctcgaacgtgtcgccgagcccgtcaccggccacgacgtgcgaccgtctccgcatgaccgaaggctcgacacctcacatctccccggcgcggatcaccgtacggggggtgcaacccggaaacccgcccttccgcatcgtggaggtcgacggagagttcgtcggcagggcgagatcgatgacggacgtgctcctgatcgcagcggaggcggggatcacgatccacgacctcgacgacctggaggtggtccactgggtcagtggcgggaagttcacctggaccatcccgggctaggccgcctcttccggaccttgccgggcccggcccgcccggcacgggctcatccgcctcagcgggtgctgtgcccgaggaccacatgggccgcgacctcaccgtcggcgtccgtgtcgataaaggacaccaccagcgggctgctgcccgtgggtccgcccgccgtggcgcgcagccggtagcgctcggtgcgtacggcctcgcgggcgagcgggccgccgcccgagaactgcgacggcggcttgacgtcgttcgcgacacggaagtcggcggccgggcgccagctgcccgaggccgggtcgaaacgttccagcaggaaacccgacccgccgcctgctccggcgccgggttcgccgaccagcatctccatctggaaggccaccagcacatgccggtatgcggcggagttgccgttccacagggtgacggtgaactcctgcggggcgccgccccgtacgagggcgagccggccgccccgggtgtcgaccgcgaccgtgagccgggtcggagccgggggaggcgtcacgatccgggtgaccgccggggccggggtcgcgggtacggaggacccgggtggcgaggaggcgggggccgacggcgaggcggaggccggacccgtgtcggacaccgacggagacaccgcggcggacgccgaaccggaggcggaaccggaggccgcgacggaggctgccgccggggccgcgccgttctcgtccccgcacccggtggcgcccgccagcaggacggcggccacggccgccgcgctcagtgcgctgcgggggcctcgggatgctggcatgtgatcggtcctccagggttcggcttcggcaggaagctagcaaggaggcggcctgccgacgaggtcgatcacgcttcggggcggcgacggttcggtcacggttgcccggcggccggtcagacgctaagcgtggcctccaggacggtgaccgcgcgtccggtgaggagtacccggtccccgtggagcgcgaccttgacctgcccggggcggcccgaggcctgcaggccggtgagggcgtcgccccggcccagccgcgccgcccagtaaggggcgagcgcggtatgggcgctgccggtgaccgggtcctcggggatgccccgggcgggagcgaagaaccgggagacgaagtcgtacccggaccccgccgcctcggccgccgcggtgacgatgaccccgcgcaccccctcgcgcagggacagggccgcgatcgcctccaggtcgggccgcagggcccgtacggcggcctcgtcgggcaggaccgtgagcagatcgccgagcgcgcccgtacggaatgtggcttcgggtcgaacccccagggcgtcggcgaggcccgcgggtaccggcacctgggcgccgggggcggccgggaagtccagggtgatctccccgtccaccccgtccactccgtcctccccgtccgacccttcggcccacgcggtgagcagaccgctggaccggctcaggaaccgcaccggaccaccggtcagcagcccctcccggcgcagggtgtgcaccgtggccaatgtggcatggccgcagaggttggcctcgacgagcggggtgaaccagcggatctcccagtcggcctcggacccggccgggagcggcagggcgaaggccgtctccggatggttcagctcggcggcgagctgccccagccatacgtcgtccggccaggggccgaccgggagcaggcacacaccggcggggtttccggtgaaggggcggctggtgaaggcgtctacgatctggatgcgcatgccgtgaacgtatcgaggccaatcagcctctgggcaaggccaattccgggaaagtggcctgatgtctcggacgggcgcgtggctgcccacctgcgtcagcggtcaggcgggctgccacagctcgatccggttgccctccggatcggcgacccagccgaatcggccgaccccctccatgtcctgcgtctcctcgtccacgtccgctcccgcggcgcgcagctgcgcgagcatcgcgtcgaggtcgcggacccggaagttgagcatggtccgctgggcgcgggacccgaagcccgaagtagtcggtctcggactcgaacgtcgcgaacaccgtcggcccggcaccctgctgccacaggccgtgttcgtcggcgtccaggcccaggcattcgcgataccacgcgctcagggcggccgggtcggccgcccgcatgaagtacccaccgattccacgtacacgttccatgcggccatgctgccccacacccccgtgcgttggcgggtggacgcgtcagccgagcggcttctcgaagctgaaagcggtcaccgccatccgttcgcggaagtagaagcggtgcgcgtcggtccgctgggtgcccgactccagcgtgagggcggtgcagccggcggccacggcgtgccgctccaggtgcgcgagcagctcgtggcccacgccggtggaacgggtggcggaggcggtgacgaggtcgtcgacgtagagcgaccgcaccgccgccgtgttgacgacgatccgccagccggccgcgcccacgcacacgccgtccgcgtcgtaggcggcggtgaagcgcagcccctggccgtgcgcctcggcgaggatgccgaggaagagctcctcggtgaggtggggacgcagttcgagcagcacgggcagcaggtccgcggtgagccgggggtcgcccggcccgaggtcgatgatcttcatgcgatgagcctacggggccgtacggggcggcccgcggccgaagccgtcgcgcgctgccgcggccgacgtgtcgaaatgggaaggacggctccgacgtccccggtgagaggctcccgatcccggagccgccgcgcagaacagaaggagtggcaccccatgaagtacatgctgatggtcctcgggaagcaggccgactacgacgccatgggcggcgccgcgaacagcgacagccccggatggtccgaggcggacctcaaggcgatgttcgactacatgggcgccctcaacgacgacctcgccgagtcgggcgaatgggtcgacgggcaaggcctggccgacccccggcacgcccgcctggtcaccgcggccgccgacggcacccccgtgatctccgacgggccgtacggggaggccaaggaggtgctcgccgggtactggatcgtcgacgtcgtcgacttcgaccgcgctgccgagatcgccgcccgcgcctacgcctgcccggtccccgagggcgcaccgaactacccggtcgtcgtccaccccgtggacagccgctcggggaccgagatgtgctgaccgattccgggcccggccccgatcccggccccacccccgcgagcgaggacctgctgcgccgactggcgccgcaggtcctcggcgcgctcgtccgccgctacgggcacttcgacgcggccgaggacgccgtacaggaggccctgattgccgccgcccggcagtggcccggggagggccgcccggccaatccgcgcggctggctgatccgcgtcgcctcccgtcggctcaccgaccagctgcgcagtgaggacgcgcgcaggcggcgcgaggagacggccgccgcgctgaccccgcgcgacgagttcgtggggccgcccccgggggagagccgggctcccgccgaggacgacaccctggccctgctcttcctgtgctgccacgccgaacttcctcccgccggccggatcgccctcaccctgcgcgcggtgggcggcctcagcaccgcggagatcgcccgcgcgctgctggtgcccgaggccacgatggcgcagcggatcagcagggcgaagcgacgcatcaaggcctcaggggcccccttcggcatccggccggacggcccggaggggagcgccgggagcgccgggagcgagggcagcgccgaacggctggccgacgtgctccacgtgctctacctgatcttcaacgagggctacaccgccacctcgggccacgacctgcagcgcgccgacctcgccgccgaggcgatccgcctcacccgcgccgtccacgcgcggctcccggccgacggcgaggtggccggcctgctggccctgatgctgctcaccgacgcccgccgggccgcccgcaccacacccgacggcgacctgatccccctcgccgagcaggaccgcacgcgctgggaccgcgccgccgtcaccgaaggggtcgccctggtcagcgacgccctcacccgcgcgccgctcggcccgtaccagctgcgtgccgccatcgcggccgtgcacgacgaggcggcgagcgacgcggacaccgactgggcggagatcctcgccctgtacgagctgctgatccgcctggtccccggccccgtcgagcgcctgggccacgcggtcgcggtggccatggtgcacgggccgcggcgggccctggccctgctcgcggacctggacggggacgcgcgcatggccggccaccaccgcctcgaagccgtacgggcccacctgctcgagatggcgggcgaccgggcggcggcgcgggccgcctacgcgaaggccgccggcctcacgctcagcgttccggagcgccgctacctccggctccgggccgccaggctcgcggattgaacgggaagggccgcgcttcagggcgtccgcatgacggacatggtccaccgctgtcagaggtgccccctactcttgatcacgtgagcccgacccctgacgatcaccccgtacccgaacgatccctcgccgacatcaacgccgacatccgccgcctcttcgcacgcgccgagggccgcctctccgacgcggagcggatccgccacgccaccctgctgggggagtgggcctccgcgatacgcgcgtcggtggtcccggccgcctgaggagggccccttccgggtctcgccgcaccggtcatgtcggacctgtcgtgtcgcaccggtcgtgtcggaccggcgatcgcggcgccggacggcagccttccctacgggcatccgcacgtacgagaaggtggaccatgagcgacctgcgcagtcttctgcagacccacgtcggtgacggatcactgcccggggcggtggccctggtggcccgcggcgaggacgtcgaggtcgcggccgtcggctccctcgacacggccggcaccgcacccatggcccgcgactccctcttccggatcgcctccgtcaccaagcccgtgaccgccgccgccaccatgatgctggtcgaggacggactgctggccctcgacctccccgtggcccgctggctgccggagctcgcggcgccgacggtggtccgtaccccgtccgcaccgctcgacgacgtggtgcccgccgaccgtcccatcaccgtcgccgacctcctcaccttccgcgccgggtacggcttccccgccgacttctcgctgcccgccgtggccccgctgttcggcgcgctgaagcagggcccgcccaggccgcaggaggtggcggagccggacgcgtggacggcggccctggggcggatcccgctcctgcaccagcccggcgaggcgtggctctacaacacctgctccgacatcctcggggtgctcatcgcccgggcgaccggacagcccttccaggacgtgctcgccgagcgcgtcttcgagccgctcggcatgcgggacaccgcgttcgccgtaccgacggagcagctccaccggttcaccagctactaccgggccgcccccgacggcggagcactggagctcgtcgacgcgcccgacggcgagtggagcactccgcccgccttcccgtccggcgccggaggcctggtgtccaccgtcgacgacctgtacgccttcggccggatgctgatcgcgggcggctcgtacgggagcggcggccggcggctgctgtcggcggactcggtgcggcagatgaccaccgatcacctcaccgctccccagcgcgccgcgggcacgctgttcctcgagggtcagggctggggcttcggcggctcggtcgacgtggcccgcctcgaccagtggaacgtaccgggccggtacggctggatcggcggcaccggcaccgccgcccacatcgtccccgccaccgggacgatcaccctgctgctgacccagcgagagctgggcggcccgaccgcccccgcggtgatgcgggagttctggacctacgccgccgcccgtccctgaccgacccgcggggtccccggccgccaggccccgcctacggctgccggcccgcggcccccgccgcccgttcccgcagccggcgcttgtccggcttgccccgcgcggtcagcgggaccgcccgtacccagaacaccgcggtgggccggtgcgccggggccaggtccttctccaccaggtcgcaggcctcggcggcgagcccggcgccgggcgcgtaccccgccgccggtaccaggaaggcgcacacctcctcgccggtgaggtcgctgtgccgccccaccaccacggcctgggcgacggccggatgccgggccagcgcggcctcgacgggcacgcagtacacgttgtccccgtgcaccatcaccacgtcgtgggcccggtcgtccaggtacaggtagccgtccgtcccgaagtgcccgaggtctccggtccgcagccatccgtcgcgcagtaccccggccgtcagccccggccgcccccagtatccggtcatcaccgcccccgaccgcatccacacctcgcccgtacggccggccgcgaccgccgtgccccgcccgtcgcgcacctccacctccactccggcgacgggccgccccaccgacgccagcagctccggccgcccgcccaccgccgcatcgtggtcggcgggggacagccggcagatcaccgccgcctcgttcgtgccgtagccctgccgccaccggccgccccagcgggtcactgcctcgcgcagccgctccgggtggacgggcgaatcgccgtaggagaccgcctccagccccggtacgccatgggcggtggcagggtcgtcaaggagccggtacaccatcgaggtcgtcaggtacgaggccaccggccgcaggcgccggcaggccgccgcgaactccgcgggtgtgaagggttcgaggatctccacccggcctccgccccgccactgctccaggcaccgccctccggagcgctgcgccagcgacgtcaccgacaggtacaccgtctccgcccagccggccggccgtacggtgttccgcgcggccatcgccccgaaggtggaagccacccccttgggcagccccgtggtcccgccggtgtaggtcacccgcgccacgtcgtcctcgcacgcccgcaccgacaccgtgccgggctcgcaccgggcggcccgccggagcagttcctccagaccgacccggggcgcaccggactcgggcaccggcacatcgtgcacgaccaggtccggccggcagtcccgcaggacgaagtccagcgcgtacagggcgggtccggcgagcaccagggtcagccgggcgcccagcaggtgcgcggcgatgcgtaccagcagcacctccggccggttcgaacccgtgacgcaggccaggcccgagccgcgcccgatccccgccccggagagcaccccggccagccgggaggccccgtcgagcacctcctggaaactcagcaccgccggcccgacgccgagcgcgggccgctccgcgtaccgctccaacgcctctaccagcgacgtgacataccgcgcggccaccatgggggactgcctctccgcgccgctccgggacaccggcatcatggacgccatgacgaacgaatcccgtgctcgttccttcagctccgcggccgcacgctacgccgcccaccgccccgcgtacccgcccgcgctcttcgacacgctggcggagatggccggctttccgctggccggggcacgggtcgccgatgtcggggcgggaacgggaatcgccaccgccctcctggaggcccgcggggccctggtggtcggggtggaaccgggcgagggcatggcgcaggagttccgccgccgcaaccccggtacgccgctggtccgggcggacggcaaccggctgccgctcgcgtccggctgcctggaccttctgacgtacgcgcagtcctggcactggacggatccggcgcacgccgttccggaggccctgcgcgtgctgcgacccggcggcgccctagccgtgtggcagaacgacccggacaccggggtcggctggatcgccgaccagcagaaccggatcgaggagcggttcggcccgggctggtacatcaacgaacgtgccctgtcgcaggaggggctgcgcttcaccgaccgccggctggcatggtcgcgccgcgttcccgtcggcacccatctggccaagctctccacccactcgctgttcctgatcggagagccgggcacggatgccttcctggaggacgaacgggccctcctcatggaccggttccccgacggatgggtggaggagcactacgtcgtcgagctgagcgtcgcggtccgggggcgtgagacccggtagcggccgttcgggtgaagcggcgcaacccgtcggcaccccgggcgttgatcaaggtgcttgtcaccgtgcactcgtgcgacagaaggaccactgatgatcaagaagttcatggccaccgccgccgccaccgcgtcgatcgtcggcgcgggtgcggccctcgccgccccggccatggccatcggcaacgacaacgggatcaacaccgtcaacggcaacaactcccagcagatctacggcaaccagaagacccacggtgacctgagcccgcagctcggcgttgtccagggcacgctgaacaagccctgcatcggtctgcccgtcaaggtcaacgcccagtcgatcctggctctcggcaacatcggtgtccaggacatcaacgtcctgtccaacccgcagaaccagcagtgcaccgagaactccacccaggccaagggcgacgagccgctctcgcacatcctggacaacatcccggtcctgtcgggcaacgtctcggccggcagctgacgcattccccttgtgcgagccggggcctccgacgcctgcgcgagtgcccacggggccccggcttgttccacccggatccacggttccacggatccgccccctccaccggcgcgcggcggccccccggccgccggggtgggcaccggaccgtacgccgcagagcctcctgcccgaccgggccggaggctctgcgcgtgtccgttccgccctcgcggtcagaaggggcgcgtcgggaggtacttgccgtcgagggtgatgacggcgcgctcgccgccctcggggtcggcgaccttcctcacgtccagcttgaagttgatcgcgctgatgatgccgtccccgaactgctcgtggaccagggccttcaaggtggtcccgtagacctggagcatctcgtggaagcggtagatcgtcggatcggtcgggatgccgccgggaatcgacccgcgggtcgggatcgtctgcaggagcagcaccgcgtcctcgtccagaccgagcagctcggcgaccgccttcgcggcggactcgggcagggcgtgctggcccagcagggcggcggtgacgaaggcgaccgacaggccggcggcgtcggcgagctgctgccaggtgaggtccttgcgggtcttcgcgtcgacggcggtgacggccagggcctggcgggcggtggggtcgaactgggcgtgcggcatcaaagtgtccttcggggagaggggagaggggagaggggagagggggatagggggcaggtgtcagacggccggggcggggcccgtgtccgtgacgcggccggagcggatgtcgtagacccagccgtgcagcgtgagggtcccggcggccagcgcgcgggccaccgacgggtgggtagccaggttcgcgagctgggcgcgcacgttctcgcggatcagggcggacacgcggtcggggcccgcggtgcccgccgtacgggccaccgaggcgtccgcgtgccccagccagcgcgcgacggacgcggcggcgctcaggtcggtgccctcggccagcgcggtcatcgccccgcaggcggagtgcccgcacacgacgacggcggtgacgccgaggacggcgaccgcgtactcgatgctggccgccaccccgtccgcgcccggggcgtgggcgggtacgagatttccggccgtgcgcacgacgaacaactcgcccggctcgctctgagtgatcagttccggcaccacacgggcatccgagcatccgatgaacagggtcgtcggccggtgcacctcggccaggtgggcgaagaggtccgccttggccggaaacacctcgcgctggaaacgcgcgacgccgtccgcgagatcggtctgcatggtcactccctgcggtgggacgggccccgtgcggggcttgacgtgttccaccatgcatgacctgcatctattgtgtccaagacgcaatatccatgcctctcatcgatgccatctatagtcgtctccatggctctggaactgcgtcacctgcgctatctgatcgccgtcgccgaacacggcagcttcacccgcgccgccgaagagctgcggatctcccagcccaccctgtcccagcaggtgaagcagctcgaacgcaccgtcggcgtccagctgttggaccggaccggacgcgccgtgcggctcaccgacgccggcgcgacgtacgtccactacgcgcgcggcgccctacgggacctcgccgcggccgagcgtgccgtactggacctggccgacctgtcccgcggccacctgcgcctcgcgctgacccccaccttcaccgcgtacctcgtcggtccgctcgtcgccgggctccacaccgcccaccccggcatcaccctggagatcagggaaatgccccaggaccgcatcgaagccggtctgctcgccgacgagcacgagctcggactcgccttcgaggggccccacctgcccgggatcgcggcgaccccgctgttcacggagaccctcggcctggtcaccgccgccgacgcggaccccggaccactgcccgtacgcgacctcgccacgcgccgactggcgctgctcagcggggacttcgccacgcgcgagcacgtcgacgcctacctcgccgcgcatggcgtgcggccgcacatcgcggtcgaggcgaactccgtgcacgccctcaccgagatcgtccggcgcaccacgctggccaccgtgctgccggacgccgtcacccacgaccacccgtacctgcgccccgtaccgctcgacccggcccttccctcccggacggtcaccctgctgcgccgggagagcgcgtacgagagcgccgcggcgcgcgccttcaccgagctcaccgcccgcctggtgcgcacccgcggctaccgccccccgccgcgcgggcacgcgcggcgggaggcggccgggagcggggtggatcacctgccggggcactccttccaggcgaggtgatagatggtgttgatgctgccgtcggtggagtccatcgtcatgtagctggtcgacgagggggacgaggtgcctctggtgacgcgcagctcggtgttgatgttgaagttccgctgcacgccgcacggcgcccagaccatctgggcccagtcggtcacgtcggtggcctgccagttgtcctcctgcggcccgctgaagttgtgggtgcgggcggcggtgtccggtgagccctggaagtagtacgaggccttctcggtggccttcgcacccggcgcgagcgaggcgtagccgcggtagtcggcgctggcgatcgcgtacgtgaagccctggggcacgtgcacgatcaggctgagctggcagttcttgcgcgccgcggtgggcggggcgccgccgccgacctgggcgaggtactggctgtaggtcacggtgaaggcggtgttgtcctgggacacggcgacctccgcggtgtccttggggcacccggatccgttgaccgtggcgacttcgatcacgatgcggtcgggcggcgggtccacgatggtggagggggtggtgtgcgtggggagggtggcggtgagcagggcgccgatcgcgccgctcacgaggaatccgccggacatggttctccattccactgcttcggtaccgggcggcgcgcgggcgggcatgcctgtgcgccggagggtggggggtgcggccggccagagcggggccgggtcgtcacagaccggtgtgcagggtggaacggggcaggcccaggaaggggaatctgggcatgtccctgacaatcccggtcggtgaagaccgggtgaccgaatcgtaggaacccagggcgcggcggaccagggcgatgtccggccaatcgcgctcccggcccggaccggccggatcacgacgaccggccggtggccgaggagcggaatcaggcggtggccggccgggccagccgctcgacgcgggccaggaactccgtgggatggaacggtttcgcgagacagtcgctcacaccggcctccagcgcgcgcgccgtgcactccgggtccgcgggcggcagcgccaggatcggcacccggccgtgatcggggtgccggcggatctcctcgaacagcgccacctcgtccaggccgggtccggtgcgctcgcagatcaccaggtcgatcgggccgtcgctgcccagcagggagacggtgtccgccccggtcccgccgtcgacgaccgagaacccccgggccacgaggagacgctccaacaggccccgcagggtggtctccttcgccaccaggaggatcctgccctgggtgtcgccgctcatgtggttcctcttcgtccgtgtggggggtcccgcagagcctacgaggcggggcgtgtgcacgcccgctccggggcacctcatccggtagcttcggtccatgagcacagagccgcagagcttcgagatcctgctggtgcccgagcacatcgagaacctgcgcggcgagcccgcggcggcccgggccttgcggtcggccacggtcgaggcgaccggtgagacgggagcctcgggctacccccactaccgcgggcagggcgtggaggccgacatcgacccgagcacgcgcacggtcgaggccctgctcgtcgacggtgcggagctgggctacgggctggtcgccatgatcgcccccgaccggggccacgacaagcactgaccggccggcactgacgggccgcaggcgccggctgctgccccgggcggctcgcctcccccgcgcgggggaggcgtccggtacgcggggaggacgtgcgggcggtgtcccggccgacagcatgaggccatgccccgatcaccgagaagccgactgatctccgcactcaccgcttgcgccggcgcgctcgcctacaccgtgagcaaggtggacctcgcgcgggacggagagctgggcatgccgggcttccccgccccgccggaggcctacgcccaggtcaccgacgtcacggccgcccagctgggcaacgccggcctcggcctgctcatggcggtcgtggccctgctgctggtccgcccgccggccgcccggtggctgcgacggtccgtggccggcgtctcctggctgggcatcgcgatggtcggggccggggtgatcggcttcggcgcccgggcggccggggtggccccgggactgggggagaggcctccccacatggcgacggccgtcgcggcgctggtggtcggcgcgctgtgggtggcgggctggtccgtggccacggcaggcgtcatgcggggcgcgcgcaccacgcccccgacgagcgccacgagcaccacgcgcgccgcccggacgcggtagccccgggcacgggaccggcccggcccccgtggtgcggggccgggccgggttcgttccggtcgggagctcaggtgggcgtcagctcacctggagggtgacgtcgtccacgacgaaggaggtctggagggactggtcctcggtgccggtgaacttcagggtgacgctctggccggcgaactgcgagaggtcgtaggacttctccgcgtagccggagttagcgttcacgttggagagggactccagggtctggccggccaccgagacggtgaaccggtcgtaggcgacgttctcgtcctcgtccgtgtcgatgtggaggaagaagccgagccggtacgtggagcagcccgacggaatcgtcagcgtctgggcggcgctgtccgtgtgggtggacccgtacccggccagccatgccttgtagctgccgccgtgcggggtctggccggactggttggtgatgacgcccgcggtcgaggtccacgggctggagccgttctcgaagccgccgttgaccacgagctggcgcggtgtgcagctgccgccaccggtgacggtgagcgtgtaggtggtggtgtggctgacggtgccggagccggtgatcgtcagggtgtaggtgccgggcgcggtgctcgcgccgacctggacggacagcgccgaggagctgccggactggacggacgtcgggctgagcgtcgcggtgaccccggccggcgcgccggagacggagagcgccacggtctgggcggcgccgctcacggtggtggtgcccaccatcgcggagacggaaccgccgggggccgcgctgcccgcggacgggctgacgccgatggagaagtcctgcgcgggggtctcaccgccgaccgcctgcttccagacggcgtaggcgacaccgtcggcgctgcggttcagcacggtggcgttgatgttgttcgtggtgtcgcaggcgctgtggtagcaggagtcgtaggcggagttggccgtgccgccccacttcgtggcctgcgccgaggtcttgcgggcgctggcgccggccgcgtagccggaggtggggatcccggcctgctggaaggagtagtcgtcgctgcggccctgtccctcggtgttctcctcgggtgccaggttcagcgaggtccagtacgccttcagcggggcggcggtggtggagttgacgttattgatgaagtagccgccgttggtggagccgaccatgtcgaagttgtagtagcccttgatggcgctgcgctgggcgctgctcagctggttgacgtagtactcggagccgttgaggccctgctcctcgtcggtccaccaggcgaagcggacgtgcttggtcatcgtcgggttcttctcggcgaggacgagggcgttctccagcagggtcgcggagcccgagccgttgtcgttgatgccggggccggccgagacgctgtcgaggtgcgcgccgaacatgacggtctggtcggcgggaccgccgggccagtcggcgatcaggttgttcgacgggtaggtgcaggaggtgcagttctgctcggtcacggtgtaaccggccgcctgcagcttgcccttcacgtacgctagcgactgggtgtagccggcgctgccggcccggcggtggccgccgttctggctcgcgatggtgttgaactgggtcaggtgcgcctgcacgttggcgacgttgatgtccggcgggtcgttgccgggctgggtcccgcccacgttgagcgagaagtcgaccgtgtgggagaggctcgcgccctggcccttgacgacgaccgtggacgcgccgggggccgcgttggcggtggccgtcagggtcagaaccgaggactggccggactgcacggtggccgggttgaaggaggcgctcacaccggccggcaggcccgacgcggtcagcgccaccgactgggcgttgcccgtggtgaccgcggtgccgaccgtggtggtgacggaggcaccctgctgcacggtgcccgaggacgggctcagcgacatggagaagtcgttgttctggccgctcggggtacaggtcgggtcggcgctctgggcgggcacgctgatcccgtcccaggcacccttcgtcttgttgaagaggtcacacgtggggtccagcgacttggccgaactcagcgtcgccgtccggtacttcttgtaggacatgctgctggtcttgagcagcatgccgccgtagaagatcttgccggcgttctgcacgcccacaccggtcagggtggtgccgttgcaggtgctgctgctgggcttgccgccgccgggactggtgccctcggccagcaggtagaaccagtggttcaggggaccggccgccgcgtgcacctcggtgccgggtatcgccgagctgtagcaggccgggtcgttgttgacggccgcggggttgtacatgttccggatcggaccccggccctggaggttgatgacctcgccgaccgtgtagtccggagtgtcgtagggggccggctcgttggcgaaggcctcggtcagcgcgccgaagatgtcgccggtggcctcgccgagcccggactcctggccgctggtaccgcccggggtgttggagtcgatggcgtgcccgtactcgtgggccaccacgtcgatgccggcgatccactcgttggcgctgttgcggccgatggtgaccgagctgccgtcccagtaggcgttcaggtcgctcaggcccaccttggcggggaagctgcggccgttgccgctgacgccgttgcggcccagccactgggagagcatgtcccactgcttctgcgccgcgaacatcaggtcgacgcagccggtctccttgctcgtggggttaccggtgccccaggagtcggaggacttcgagaagaccgtaccggtgctgtagtcggcgcagctcaggccggtccggttcgggtcgcgcagcgtgtacgtggagcccgaggccgtggtgtcgatggtgaccgggcccggcccgttccacttgctgttgccggtgcccgcgaccacctcgtcgtaactgtcgacgaaggcgccggtccgtgcgtccacgaagacgtgcagcctgctgggcgcggtcctggtccggccgctcagtacggtctcccacgccagcaccggcttgtcgtccttgaggcggaccacgagccggctgctctcgaccttgtcgaccgaggccagcttcgcccgggaggcggcctcggcgtccttagcggagaccgacgcccgggtggagacgtcgatgcgtacggaggaggcggactgcagggcacgcaccttgccggtaccgtcggcgagcacgaccgcgtcgccgccgacgaccggcagaccgcggtaactgcgctcgtacgacaccgagtagaggtccttcacccagggggtgacgaggcgtcgttcgtactgttcctgggaggagttgaccagggagtccaggccgctgtcgacggccaggtcggcggccgcgaccgcacgtgcggccggtgtgtccttctgggacggggagggctgcgccggctgcgccgccgatgccgtcccggccagagcgccggcaaggctcgcggtcagcgccatcgctgccacggccgccgtccatctgctgggatgcaacgtccactccgatcgtggggggtcggggatgagtgtcgttcgcggccgagtatgagcgtgaacatgacgagattgggacatctcgtggggcataaggtccgcgttatggtgccgtggcggcccggctcgtacgctgcccggatgcagctggagttgaggcatctgcaagccgtctgccggatagcggaggctggcagcctggggggcgcggcgcggcggctcggggtgtcccaacccgcactgtcggcccagctgcgccgcatcgaacgggtcaccgggggcgagctcttcgtacggggccgcagcggggtggaacccacggcactgggccagttcgtgctggccaaggcacgtcgcgtactgagcgagatggacgctctcggagcgcaggcacgcgccatctcgaccggcggaccgctgcggctgggctgcatcatgctcgtgctgctcgacggtctcctcgcccagaccgacctgtccatgtcaggccgggagatagccgtggacctggaggattcggtcaccgtgctggcgcggatgctcggcgccgggcgctacgacgccatcgtgtacggggaggtcaacgaccacgaggtgccgctgccggaaggaaccctggccaggacgctgatcccgaaggagccgttctgcatccggctgtccgccgggcaccccctcgcgggcctggagcgcgtcgaactggccgacctggccggggagtcgtggatgacactggtggaggacgacgacggcggccccgaggcgctcgtcacggcctgcgcgaaggccggattcagcccctcactgcgctaccggatcaccgaccgcaagatgcagcacgacctgatcgccgcgggacgcgccgtcgcgctgagccagccgacggccccgtcgggggagggcacggtgatgcgcccgctcgtcggcacccccatcatcggccgcatccgcctcgcctggcgccgcgccgcgctctcggccgggcaggcggaactgctctaccgggccgcggcccgcgcctacctggccaatgtggacaacaaccccttccacaaggagtggtgggacgcccacccggaggtccatccggtcctcgactgaccggtgggcggacccgaagccgccggcggacggacggacggagggacggagggacgggccgagggacgggccgggggagggatcggcgatcagccgcggcggtgcgccgtcagcagcaggtactcccactccatgacaccgtccacggtgtgctcggcggccagggcgtcgagcgccgcgtccagctcggcgacccggtccggatcgccggcgacggcgcggtagacggccacggtgggcccgtagcaggccttgaagaactcgcggaagtccgaaggcccggtgaaccggtccacgcggaccgtccggcgccgcgactccacgtcggtgaccgcgtcacccagcagctcgtgcacgtgctcctcgtccccccacaacgggggcggctgggcaccgggcggcggcgggggagcgaagggcttcatggtggcgaacatgcggcccacgaagccctgcggggtccagttgatcagtccgacggtgccgccggagcggcagacgcgcagcatctcctcggcggcgggccggtggtgcggggcgaacatgatgccgacgcaggacatcacgacatcgaactcgccgtcggcgaagggcaggtgctcggcgtccgcctcccgccactccagagcggcaccgcgcacggtggacagatgccggccgatctccagcagatcgggggtgaggtcggacgccaccacgtcggccccggccagggcggccgggatggccgcgttgcccgagcccgccgcgatgtccagcacccggtcgccgcgctggacgccgcactccttcacgagcacggcccccagctccggaatgacgtggtgggccaccgactggtagtcacccatcgcccacatcgcgcggtgccgggccttcagagtgcggtccgcctgggccgcctcgctcgcctcggtcatgacagccgtcctccagggctcgggtagccccttgtccgagcataggtacgtttcgcggacccggcccgtcggcggtcccgcgggcgaccggcggcgccggtgggcccgtaccccggctcacccgccggtacggtcccgggacgccaggcggccgaagtcacgcgtgaagccctcgcggaagccgggccgctccagggccctctcgaaggcgcgcgcggcccgggtgagcgcggcctcgttctcctgggcggtggcgagttgggcgaggtacgcgcgcaggctcagtccgcggtccgcggcgagcgcggcgaggcggtcgtgcacatcggtgtcgacctcgacggtggtggtgtcggccatgctccgagtatgcgcgccccgtgaccgggcgggggcccgttcggcacaggcgtgctgcccacggggcacggtcccggtaggtcgccgaggtggccgaggtgcggcggtgacggaacggaccggggaccaccgcgtcaggcgcgccgcctcagctctgcgcctgctggaggagggagatctgccgggcgatcagggcgggcgggaaggcacgcaggtccgggtcgccgaccgacagtttggtgaacgtcgcgatgacactgccggtgcggaccaccgtgtactgggtgacgtgcgagcccccctcggtcggggcggtgatctcgaactgcaccgcttcgtccccgagccgcggggcgggaccgaccgtgaccgtgcccttgtaggtcgtggccgggcccgggctctcgtagtaacggcaggcgcccagaccgtcgctgacctcagcgaagaccgccaccgcgccggagttcccgtacgaggcgagcgtggagtcgccgccgttggggtcgttcctccagttgaacgtctgctcggccaccgccggggccggacgggagggccgccgggcatgggcggcctccagcagccgtgcgcaggcgggatcggagacctcggactcccgctcgcctgcccggggccggcggacggagacggggtgcccgtacgcgtccgggctcgcctcggtcggcagggcggccgccaccagctcctcggcggtcagcgtacggctcgcggaggcgggcgcggagggagagccggacgcagacgtggaaggggccgcgggcgcggtcaccgggttcccgggatgcgctccgcagcccacgacggccagcgaggccacggccaccagggccgacaggagggaagcccgccgggcaacgtgtacaggcatggtccgtccccggaacgatgtgagtgatcatgcggaggctaccggcccgcaccccgccgccaccagggggttccgcctgttgggatccgctgcccgggctgcgggagcgggtgcgacagtccggggccgtcggaccgtccgccggtcactttcgtcccgccagggagttcgcgggggcgaggacttcggcgatgcgggcggcgatggtctgcgccgtgttgtccccgggtgccttgggccccaccgtggtggagaccgcgatggccaggtgcttgctcgggaggtaggcctggatggccgcgtatccggcgaacgacgggttcgactggatccagccgttctggacgatcacgccgtacccgaagtgctcggccggaagctggcggaagcagtccctgggcgggcagcccggggtgttgccgccgaggcccaccgtgcccgggtcgagctggaccttgaaactctgcggtgagaggagctcgcccgtaccgacggcctcggccgagcgcgccaggtcgcagatgtgggtggtcaggaccgcgccgggggcggtggtccaggagggattccagaaggtcgactcctcgtacctgccgcgctccgcgtcgaaggagtgcaggacgggctcctcgatctggggcgtgaagctgttgagggtgttggccagtccggcgggccccgtgatctgctgctccatcacctgggccagcggcatcccggcgatcttctccagggcctgcccgaggagcacgaagttcgcgtgcgagtagctccagctcgtccccggctcgtaccagagggggtgggcggcggagatgcccacgagctcggcgggcgtccactgacggaacgggtcggcgtacagggccgcgaggaacttcggatccggcacgtagtcacgcaggcccgaggtggaggcgccgagcatgcgcagggtgatccggtcggcgtgcggcgcgtcgggaagccagcgcgagaccgggtcgtcgaggccggccttgccctgctcgaccagttgcagcatggcgatgcccatgtagacgatggcgaccgacccggcccggaagtgcatgtccgccgtggcggggacccccgtcatcgactcgccgagcgcgccggtgacgacctcctgcccgtcacgcgtgacccgcagcacgacggcgttcaggtccagttccttctgcgccgccctggcgatgtccatgatctgtttcgcttcgccgcccgagggctcgggcgacgccacgcacggggcgggcgtggaacccgcgccgttcgccgcccaagcgccgccggccggcaggaccgtgccgagcagtgcggtggcgcacagcagtgccgttcggacgcggcccgggtgcgcggtcctgactcggatcatgcccatctcctgccgcgaagggcccctcgggacagggcccacccttcgatggaacgcccaccgtccggtatgggccagtcggcgcagtggcggcaccgggcgtcgcgacccggcaagatccgaaagagaaggcctagccggcccagcggccggtgaggaaggtgagggcgaccacggtggacaggggcgccacggcgtagaggtaggcggtgtggatccggggacgcttcaggctccaggaggccaggccgatccacagcggccaccacaggagggtggaacggggcagggacgtgtaccagtaggaggtgcccagggcccacagggtgaggccgatgtacagggcttcgggccagcggccgccccgtaccagcagggccaggagtacggcaccgaccagcatggccaggagctcggcctgccacatgaacgcgtacccggtgggctggacgtgctggaacgcggcctcccatgtgtgggcccaggcctcccacggtgcgtggaagtcgcggaaccagccgcgttcctgggagtgcttccaggccatccagtccccggttcgcgtgtgcaggtaccagctgtagagggccggggcgagggcgggcaggaagagccacggggccgaacgccaggcggcgcggccgcgggcggtgaggacgaagtggagggcgagggcggccgcgaggaacagccccgtgacacggaccgagcaggcgaggcaggccagtaccgcggccgcgggccagttctggcgctgcgccgcgagccaggcgggcagggccagcgcgaggaagagcgcctcggtgtagcccgcggcgaggaacacggcgcatggcgagagcagcaggaaggcagccgcacggcggcccgtttcgaggtcggccaggtgatggcgggcgatccgggcgagggccaggacggcgatgccccccgagaggaacgagatcagcgctccggcggcggcccagtcggggaccacggtgtgaacggcgcgcagggcgagggggaagccggggaggaaggcctcccggttgtcccagccggccgtccagggtccggcccccgcggggaagtagccgtcctgggctatgtggaggtagaaccaccagtcccattgctgccagggagagagcagcgaggcgggccggcgggtctggccgtcggcggggaacagccagctgacggcacccgcggtggcccagatgccgacgcgggtcagcaggtacagccacaacacctcgcgctcgcccgggccgagcctcaggaacgccgggcgggagcggcgggggcggtgggggcggcgaccggtctcgttcacgggcggccaggcggtgggcgggccgggaagctcgaccggccgacgggcggttgaaacggacatatctggatctcctggccgtctgagggcatgcggggtcaccggcccggctcgggccggtgtccgccggcggtgtgctgcgggaagaggggagggctaccggagcggctgtgggggagtggccgacatgctcggctccaccgtcccggtggaagagggcggcggcgccgtcgtggtgcgcgccggcaccgtgctgctgcgcgccggcggtggcgtggtgttgcgcggcggcatcagcgagttgagcgtgggtgtcgtggagtgggacggcgggggcggtgcggaggtcggggacggggccgccggagagggcgtcgtcgcgggaaggaccgggcccgagtcctccgggaggaacgccgagagggcggcgcccgatccggcgaggacgaggaggcaggcggcggcgataccgacgatccggttccggcggtgccgttcgccgcgccgctcgatgaccgcgacgggcggggtcgtgctcgcggactgtccggcggaggccgcttcccggaacagggaccgcagcgggtcgtgggagtcaggcatcgggagcctcctcaatgcgggggtcctgcagatggagggcgagcgtggtgcggccccgggacagatgggtcttgaccgtgctcgtggacagggaggtctcggcggcgatctgctcgacgctcagatcgcacacgtagtgcagcgccatggtccggcgctgcttcaggggcagttgccgcagtgcctcgacgagcgccaccacctccggacccggcccctccacgtgaccggcgggggccgtgcgctgccaggcgtcggcggtgcgccgccgcccgcgccagcggctgacggcgagtcgccacgcgaccgtgcggatccacgcctcgggccggccgtcccggtccagctgacgccggcggccccaccccctgacgaaggcctcctgcaccacgtcctgtgcctcgtggtggtcgccgagcatcacgtagagctgtcctgtgagccgtcctgccgcttgcgcgtagaactcctcgaactcctcgatggtcaaaaaatcgctcccgaatccatgtgtccctctcaccgggcatacgcccgccgcaccccatccggtcgacaccggacgacaagtcgccgtgtgagtgccgtcacacggtgggtggggtactcatcgtcgaggcggccacggcgaggagacgcggcggcgccacgggccgcggggtgatgcggatccgggcctcgggccggtccgggcgatcgcgtcgggcggcgcgcggaggggtccggcgcggcagaagacagaagggccccgacagggcggacaggtcccgacacagcagaagggcccggatccatgaggatccgggcccttccgagcagtagcggggacaggatttgaacctgcgacctctgggttatgagcccagcgagctaccgagctgctccaccccgcgtcggtagacctcagcctacggcatcccgggggcggtgctcgacatgtttaccggcggccgcgcccggagtgtgggcgaaagggcggaatctcgccccgaaggcgagatcattccccctggtgacagtgcgtgcaggcgtgtaccttcacgggtagctgtcgtggttccaagtgccttgcccgtgccctttggtgtgggcagttttgctgtgttgtgccgtaggaccagggcgatcacctccgtcttccacgccgtgtggaagacgtacgtcaacgggaaggcatgaacatggctacgggaactgtgaagtggttcaactcggaaaagggcttcggcttcatcgcccaggacggcggcggtccggacgtcttcgcccactactcggcgatcaacgcctctggctaccgtgagctccaggagggtcaggccgtgaccttcgacatcacgcagggccagaagggcccgcaggcggagaacatcacccccgcctgattccggacgacggcccggtccgacgaccgggcgccggagaaccgtttccccgtaccgcccgttcactgaacgggccgcggggaaagatcagggccgtgcggcgtcgccgcacggccctgatccgtctgcccggctccgcccggtgccacgcgccgaccggccgccgtacggacgggaccacgtcggccgtcacacgacagaagtcgtcctgacgcgccgcagcccccagacccgtaccgcggccccgatcacggcgagtgcgacggtcgcgatccccgaggccgccagcacctgccggggcccgagcagcgcgatcagcggtcccccgagcgcggtgcccaccggcccggcggtcaggagggcggcgctgcgggcggcgaggaccgtggtcagggaggcggccggggtgcgttcctggaagagggtgtaggacagcgccgtgaacggcccgtagatcaggccgccgagggtgaaacaggccagggtgacggccgcgggcgcgccgaggccgaaaggtacgagcgccagcccccagcccgcgacgatccccagcgtgaccggccagagcgggaaccgctgcagcgcgcccgcggccaggccgcccagcacggcgcccgctccgaacagcgtccagtacagcccgagcagacccgccccggcgtgcaggtcgtcggtgacgtgcaacgggagcgcgacctccgccggcccgtagaggaagttgaagaaccaggtcagggccaggacgccgaggagctcgggctgtgtacgcagcagtcgcaggccggccgccgaccggtcggcgtcgaccggcgtggccgtggttgcctcctcgcccgtcccacccttcccgtcctgcccggccgccacgccccgcagccgcccgacctgggcggcgagcacggcgaaggacagcgcgtcgaggccgatgagccaggccggagcgatcacggccgccaggaacccggcgagggcggggccgaccacgatggaggccgagacgctggaactgaccagcgcgttggcggccagccgctggtcgggcggaagtatctgcgcgagcagggagtacctgcccgcgttcccccacgcgtgcaggacggacgagcccgccagcagcgccacgtacagcaccgggtgcagcacccccgcggcccaggccagcggcacacagccgaggagcaccgcgcggatccggctgtcggccgccagcagccggccggcgggaagccggcgcagccaccgcccgaagagcagggctcccgcggcccccggaagcgcgtacgcggcgagcgcggcacccaggagcatcccggactgccccgggggagcgatctcgatggccagccacgccacggcgaccacgctcatcccgtcaccgagatcggaggccgccagcgcgggcagcagccgccggaagtcggcatgggcgaacagcggccggtaggcctgggggaggaggcgagttgtctgtacgcgagtcaccaggtcagactcatggttcaagcgcgcttgaagtcaagggggagtgacgggtgcgacagctcgggatcggtgagctcgcccggcaggtgggaatgcagccatcggccctgcgctactacgagagcgtcggcctgctgccgcccgccgaacgggccgcgggccggcgcgtctacccggccggcacggtccggcggctcgcgctgatcaagatggcccagcgggccggattcaccctggccgagatccgcggtctgctcgacggcgacgccgagcgcggcgcgacccggcagtggcgcgccctggccgagagcaagctccccgaactggaccggttcatcgagcagacgcggatcctgcggaacgccgtcgccgactgcctggcgtgcggttgcatgaacttcgagaagtgcgcgctgctctccgccgacggtcccggcgcctgatccgcgcccgatcgtccctgcccggtcatccgcgccggctccacgcacccggaccggccgatcgggaagccctgcgggatgaggcatgatcgggggatgtctgatcgcatcattgccgcctgtgacggagcggccaaaggtaatcccgggccggccggatggggttgggtcatcgccgacgcccagggacaccccgagcgttgggaggccggcccgctggggcgggccaccaacaacatcggtgagctgaccgccctccagcggctgctggaggcggtggacccggggacgcccgtcgaggtgcggatggactcccagtacgcgatgaaggccgtgacccagtggcttccgggctggaagcgcaacgggtggaagaccgcctccggccagccggtcgccaaccgtgaactggtcgaggcgatcgaccggctgctggcgggccgggacgtgaccttccagtacgttccggcgcaccgcgaggacggcgaccacctgaacgcgatcgccgaccaggccgccagcgacgcggcggtccggcaggaggccgcgggtacggcgctcggcagcccggacatgccggtaccggatcccgccgcggcctcgccggtgcgccgtagagcggccgcaccggggaagcgcgcgtccgcgggcgccgcgtcgggcggcggcggatcccgggccatcaaggcgaagttccccggcagctgcgcctgcggaaagccctacgccgccggtgacatgatcaccaagaacggcagccgttggggtcaccaagcctgcggttcgtcagggccggtggacgcgtaggtactccacctcgtaggacatctgcgagacgcccggctcgggcgccgggtgatagcggccggcgcacacggacagattgacgatgaggtacgcccgccagttgcgcccgactccccggcggtcggcgaagacccgggtgccgttgacccaccacaccaccgagcgtgacccgaactcgaccttgaggtccacccagccgccgggcgcgatgccggagtcgcggtggtagcgcgagccgcccttgacgtggttggagagttcgagcaggtcggggttgtcggggtggtactcgaagacgtcgatctcgttgccgccgtcccgccaggtccagatcgcgggccacgccccgatctcggcgggcagccgcacccgggactccagtacgtcaccggtccgcaccatgaacccttcgtcgctgccctcggtggtcagcagtcccgcgctccacttgccgtcggggcggcgggtcgcgcggaacgtgccggtacggctgtaggaggggtcggtcaccaggtagtcgagtttgttgtcaccggtgttggtgggaccgccgttcggataggcccaggaccggccggcgacccactgggtggccgaccggaagtccgcggtgaaggccggggcccgggcgctcgtcggcgtggccccggtgtcgggggtgccggtggagcgtcctgtgagccgtcggagccaagtgagaacctgagtgagcacgagcggctccttccccatgtcatggacgcttctgcagcatgcccagcggtggtgcgatacataccggtggaccggtttgtatatgagtcgcctcgtcaggtaataatcgatagacggatagacccattacatgtgagggtggcttccatggggaccgcctgggtccgggcggccgactcgaagaactgtgcgaggagttgcaccggtatgtggaagtgtgagcgtgtcatcggcgccgacctggacgtcgaggaggtgctcggtgtctaccgtgcgtccaccctcgccgagcgccgtcccgtggacgacgtcgagcgcttcacccggatgctggccggagccaacctcgtcgtcgtcgcccggaccgaggacggccgcctgatcggcatcgcccgttcgatcaccgacggcgcgtactcgacctacctgggcgacctcgccgtcgatgtcgcccaccaggggcagggcgtgggccgcgagctcatccgcgtcacgcgggaagaggtgcccgaggcgaagctggtcctgctcgccgcgccggccgcggtcgactactacccgcacgtcggcttcacccggcacgagtccgcctggaccctgaaccgcctgaagtaagaagagagtggacctcaacatcctttttccataagccagttacgcgcacccacggacgggtaccatccgtgccgtggggggactggtgggacagagcagagggaagtccgtgctgcgcgcctgcggctgcgcggtggcgggcttgttcctgatcgccgggtgcacggccgacggtacgcccaagggcggtgcggcgaccggcactccgggcgcgtcggccacggccccgggcacgccgtccggcacgggcggtgcgggcgcgggcagtagcggagcgagcaccccgaccgccgcacccggcacgcccgtcccgatcccgatgcccgcgctcgacgactccaagcagccgaagacggccgccgaggcccgcgccctgctcggccgcatcatcatcgccgagcaggccctcgggcccgagttcgtacgcagcaccccgttcgagagcgatccgggccgctggcccgtgctcgacgaggcctgcgtctggcagaccgagggcctgccggacgacgtgctcgccacgagcacccgccacttccacatccccgccgcggacggccgcggccgcgtacggatcaacgccacggtcaccgtccaccacaaccgcggggaatccggctgggagaccgcccgcgcgatggaagaggtcctgcgctgccccgaccagaagctgcgtgagggcgaggagctcaagggcctttggggcggagtcttctacctcggcgagcagatgaacggctggaccgaggacgccttcaccgaatccggcaagtacatcggcgcgcaggacggcgggccctactactacacctggtcgcaggcccagtacggacccgtcaccgtggccatcgccgccaggggaacgaagggcatcaccgacgaggaactgaccgccttcgtggtccagggcaccagccggatgatgctgcaggccaagcaggagctcggaaaggcggcgggctgatggagccgctccacccctcggacccctcccggatcggcggccaccggctcctcggacgcctcggcgcgggcggcatgggcgtcgtctacctcggccggaccgaagacggcgcgctcgccgcggtcaaggtgatccgcgcggagtacgccgaagaggccgacttccgggcccgtttccgccgcgaggccgagatcgccgccgaggtggacagcccctgggccgtccgcatcaccggcgccgacccggacgcccccgaaccatggctcgccacctccttcgtcgccggtccctccctcgccgaggccgtggcggcccacggcccgctcccgctgcgcgccgtacggatcctcggcaaggccatggccaaggccctcggggtgatgcacgcgcagggcctcgtacaccgggacgtgaagcccgggaacgtcctcctcgggatggaccggccccggctcatcgacttcgggatcgcccgtggcggcgagcacaccgccctgacctccgccgacgccgtactcggcacccccggcttcctcccgcccgagcaggccgagggccgccccgccgaaccggccggcgacgtcttctcgctcggctgcctcctcgcctacgccgccaccggacggctgcccttcggcaccggcaccgtggacgcggtcctctaccgcacggtccacgacgagcccgacttcggacccgaagtcctcgccgaccccgaactcaccgcgttgctgcgcgcctgcgtcgccaagcaccccgacatccgccccggcgcgagcgagctggacgcggcactgaccgaggacaccccgggggagggcaccgactggctgcccgacccggtcgtcgccaccatcgccgaacgcgccgccgcgctgctcgccctgcccggcatcgacgagaccgtcgccgacccggacgccgcccccgcacccggaacggccccgacggctccctcccgcagacggttcctcgccctcgcctccggcggcgccgtcctcgcggccggcggcggcctggccgcctggctggccctgcgcgagcccggaaagcccgggacacccgccgcggacgccccgcggcgctgggtcatcggggtgcacgccgacctctccggcccgcagaaggccgccggacaggcccaggaacgcggggtgcgcctggccgtcgacgccttcaactcccgcaaggaaaagcccttcacgctcaccgtcgccaccgccgacgacgccggccgggcggaccggtcggcggccgccgccaccggactcatcgccgaccgcgacctgttcgccgtggtcggccccaccggcaacgactccgtgatcccgtgcctcgaactctacggcgagagctccgtacccctggtgacggtgtcggccctggccaccaccttcagcatcaccgaccggcgcagcttcttccagagctgcccgatcgcctcggcacaggccgccgccgtcaacctgcaactcgccgggaagcagggcgtccggcggatgggcatcctcagcgaccgcggcggggacaccgacacctggcagacggccctgctcctgggccgcaccatcgcctacttcgcacccgaggccacctactacgggcgcgtcgtcccccgcggggtccaggacctgtccccggtggtcgccgacatgctcgcgcacggcgtcgacggcttcttctacacgggcaccccggccggcggagccaaggtcgccgcgtcgctggccgcagccggattccggggcccccgggtggccgactacaccatcgccggcgccgagttcctcaccgcggccggcccggcggccgaagcctggcagttcttcacgccgtacaccggcccggaggcccccgaggtcgcggagatgacccgcgcgcaccgggcggcgtacggaacggccccggacatctggacggcggaggccttcgacgcgacccgcctgatcatcgaccggctggtcgcggccgcggcgggcggcgcgcgcccgacccgtgccgggctgctgaccgcgctcacccagggcaccttccgcggcctcaccaaggagtacgccttcgacgaccggcggaaggtcaagggcaacgtctacttcatgcaccaggtggagggcggccggatccgctacgtcggcccggccgtccagcccgcggcgggatagtccccgatgcggcccctcactcccgccgatccggccgcgatcggcggcaaccggctgctgggacgcctcggttcgggcggcatgggcaccgtgtacctggcccgctccgccgcgggcaccctggtcgccgtcaaggtcatccgcgccgaccacgcggcgaacccggacttccgcgcccggttccggcgcgaggtggaggccgccgggcagctgaccgggcgctgggtggtcccggtcgtcgccgccgacccgcaggcgcgcgagccctggctggccacgccctacgtccccgggccctccctggccgaggccgtgggcggctacggcccgctgcccgtccgggcggtccgcaccctgggcgcgcggctcgcggaggcgctcgcgcaggtgcacgccgccgggctggtccaccgcgacgtcaaaccgggcaacatcctgctcgccccggacgggccccgtctgatcgacttcgggatcgcacgggccgagggcgcggtcacgctcaccgccgtcgacgccgtcctcggcaccccgggatacctggcgccggaacaggcccgcacggacggcgccgcggcgggcgccccgagcgacgtgttctccctcggctgcgtcctggcgtacgcggcgaccgggcgcggccccttcggcggcgggcacgcggccgcggtggtctaccgtacggtgcacgacgagcccgaactcgccgcacttcctgcggagttgctcgacaccgtacgggcctgcctggcgaaggacccggcggcccggccgaccccgcaggcgctgcgcggcgtactcggccacggcctccccggcccggacgccgaggactggctgccgcccccgctgccccggctcatcgccgaacgttccaccagggccctggacctgcccgcccccgagccgacccggatcgacgtgccggagacggccgtacggggcctcacgcgcagacggctgctggcggccggcgcgggcctggccgtcgtcggcgcaccggtcgcctggttcaccacccgcggccgggcccgcggcacgaccgcgcccccggaccgcgaactcgccacccacaccctcgccctgcaggccgacctgaccggatccggcaaggagaccggccaggcccacgagcgcggtatgaaactcgccgtggagcggcacaacggccgctcggatgcggcgttccggctggccctgcgcgtcgccgacgacggcggggaccccgcgcgcgccgccgagctggtcaaggagctggccgccgaccccgcggtgctcgcactcaccggccccacctgggacgcggccgtacccgcgatggccaccgcctgcggcacggccgacctcgccctgctgctggtgtccgccgacatcaccgagaccgccacctccgagccgggatggcgcacggtggtcgccacccgcccggcgggcgaccagctcgccctccccgtcgtcgactacttcagccgcatcgggcccgtccaccgcacgggcctggtggaggacgccgaaggcggcgagcccgcctatccgctcatccgggccctgcagcagtccccgccgtcccagggcacggtcagcgtccaccggatcccggcgggcggcaccgacttcgccgccgtcgtacgcgcgctgaccgaggccggggcggaggccgtcgtctacgccggcacctcaccgcagcgcgcggccctgatggcccgcgccctgaccgagggcggattccagggccggcggatgggcatccagcacgccatggaaccggccttcctcgcggccgccggaccggccgccgagggctggctgttcagctccctcttcaccgacccgctggccgttcccgccgccgccgacttcgtcgccgcccaccgcgccgcgtacgggcagccgcccgcccgctgggccaccgaggcgtacgacgccgtgggcctcctggccgcgaccctgaccggcctgggggaggaggggcgggaccgggcgggcgtgacccgccggatcttccggacgagccacgagggcctggccaagccgctgtccttcgacaccaacacgcacgtgctgaacaggatcggcaccgcccacctctaccaggtcgaatcgggcgccttccggtacctgggccgctacacggaggtcaagccggcgtccggacggtgacgacgggcggcgactgcggacagtgactactcgaaccgggagacgtcgcccgctccccggcgcacgatctcgacgtcaccgccggagaagtcgatgacggtggtcggctcggtaccgcagtcacccgagtccagtacggcgtccacctcgtggtcgagccgctccttgatctcccagccctgcgtcatcggctcgggctcgtcgggcagcaggagggtgctggagagcagcggttcgccgagctcggcgagcagggcctgggtgacgacgtggtcgggaatccggacaccgaccgtcttcttcttcgggtgcagcagctggcgcggcacctccgacgtcgcggggaggatgaaggtgtaactgccgggggtcgaggccttgatggcgcggaacacgtcgttgtcgatctggacgaaccggcccagctgcgcgaagttctggcacaccagggtgaagtggtgacggtcgtcgaggttgcggatcgaccggatccggttgatgccgtcgcggttgcccagctggcagcccagcgcgaagcaggagtccgtcgggtacgcgacgagcttcccgccgcggatcatgtccaccacgctgtcgatggtgcgccgctggggattctcggggtgaacgtcgaagtatttcgccatccgccgagcctacgcgctcggcgacccggctccggtacgcccggacccggctgccgggaggcgcggtaccggtgcgacgattgcgcggatgcgcacgctgaacgaactgatcgacatcgacggacccgcctggcccgaactgagcgaggagctcggcgcgggagccgtgcccatggaggtgctgcccgccgatcccgcgctggcccgggcgtcactcctccagctgcaggtcacggcgcgctcgtacctgggcgcgatggtgctgcactgcggcggcctgctcctggacgacggctggctgcgggtcctcggcagcccggccgccgaccgctcgcggggactgcccgcactcgccggggccaacggcttccccacggcgttcgaccccggctggcgcccggatgccgggctcgtggtggcgtacgacgcgctgggcggggtcttcgccctgaacggcgcgcgtcccgccgacagcggccgccccggaggaccgggcgagatggtctacttcgcccccgacacgctgcgctgggaggccctcggggccggccactcggcgtggctcacctggctgctgtccggcgccctcgaccagttctacgccgacctgcgctggcccgggtggcgggaggaggtcgcggaactgaacggcgaccgggggctgtcgctccaccctcccctgtggtccgccgagggccgccgcgacgtggccgcgaccagccgtcgggccgtccccatggcggagctgctgggcatcgcccgggaaaccggacggcagttcgacggggccgacccgggattcatgggcgcggtctgacggatcgggggaccggccgggccggggccgcggcccggcccggccgttcctcgtcgaccaggagtttcgcgccccgccgagcgcgtgggcggccgtcgtcatgcgcccggccgtacgaacgcccgagcccgccggccccggccgaacggcggcctcggaccccggcgaacgtcggggttgcgccgtccgccgttccgtgcggggcgaccgcggtgcgagcccctggcgcggccggcgcggacgctccggacgctgccgggcgggttcgggggcacgatgagaggaagccgtgcgcctcggcccgccgcaggggcgggtggcggcgggcggtgccgggccgacgatgccggaaggagcgtcgccgatgggtgcgatcgacgggtcggggaccggtgggatcagatccggcatggccggggtgtccccgccgagcggtttgctggacgtcctgaacgtcgcggcggtcgtcctcgactccgaaggacgggtcgcgctgtggagcccgcaggccgagcagttgttcggctggacgacggcggaggcactcggccgccccgccgcccggctgctggcggccccggagcacgtaggcctggtcacggagctgttcgcgcgggtcatgggcggcgcgggggactgggcgggtgccttccccgtgcggcgcagggacggcaccacgcgtttggtggagttccgcaacatgcggctgctcgacgagcacggagaccggttcgccctgggcatcgcgaccgaccgcacccggttgcgccagctggagcgggacctcgccctgtccgcgcgcctggtggcgcagtccccgatcggcctggcggtcctggacacggagctgcggtacgtgctcgtgaaccccacgctggagcggatcaacgggctgcccgccgaccagcacatcggccggggcgtccgcgaggccctggccttcctcgacgatacggaggccgccgagtcggcgatgcgccaggtcctggccaccggaaggccgctgctcgagcagttcacggccggccgcacccacggcggagaccgcaccgaacacgcctggtcggtgtcgtactaccggctggaagacgccaccggccgggtcctgggcctggccacctccgtagtggacgtcacccagagtcaccaggcggccatcgagatcgcccgcagccgccgccggctcgccctcatcgcggacgccaccgtgcgcatcggcaccaccctcgacctcgaccagaccgcccgcgagctcgccgacgtggtcgtgcccgagctcgccgacatcgccgccgtcgacatcctcgactccgtcctcgagggccgtccgaccctgcggtcctccgcccacgaacccgcggtgttccgggctctggccctcgcggctgcctaccccagcgatgccgtccgcgccgccgacccgcccggcgacatcgcgcgctacgccgcggaccggctggtcacccagtccgtgacgaccggccacccggtcctcgtcgcccacgtacaggcccaggacatctcgcgcatcgcccgcgacagcaccgccgccagcctcctgagccgcgccggactgcgctcctacctggccgtgccgctcatcgcccgcggcgaggtcctcggggccctcgacctcaaacgcacccgcaacccgctgccgttcaacgacgacgacatcgtgctcgccggtgaactcgcagcccgcgccgccgtgtgcatcgacaacgcccgctggtaccgcaacgcgcaccacaccgccctcgccctccaacaccatctgctgccgcaccacccaccgcccacacccggcctggaggtcgcctaccgctaccggcccgccgcggccagcagcgagatcgggggcgactggttcgacgccatcgccggaccggacgacaccaccgtcctcgtcgtcggggacgtcatgggcagcggcatcaacgccgccgccagcatgggccagctgcgcacggcgacccgcaccctcgccgaactcgccctcgacccgccccaggtgctccaccagctcgaccacacgaccgccgcgctggaggagaccatcgccacctgcgtctacgtcgtctacgacccgcacgccgcccagtgccgggtcgccctcgccggacacctgccccccgtcctcatccgctccggccgcctgccccgactcctcgacctgcccaccggcgcaccgctcggcgtcggcggcatccccttcgagtccaccgccatcgccatggaccccggcgaccaactcgtcctctacaccgacggactggtcgagacccgcgaccagcccatcgacgaacgcctcgacctcctgctgaccctgctcgccgacaccggacgtccactggaggagacctgcgaccgcctcctggactccctgcggcgcacggacgaccacgacgacgtcgccctggtcatcgcccgggcccggcccctgccgacgggctccgcctgacccctggcacgccgcccgcgcgccggagaccgccgacggcgactgttatcgtccggggtatgcccgagctcatagcccccacgtcccacctgcacgcctcctggctcgacgcacagcgggaatggggacccgacgcccacctggacggcggcgggctcggcgccgacgacgaagtggacaccccggagggcttcgcggcctgggtggagcgcctgcgccgctactcggaccgcaccctgcccgtcgaccacggccgggtccacgcgacgtactggtggatcgccgagggcgacacgtacctgggcgcgatcgacctgcgccactacctgaacggcttcctcctcgacgcgggcggccacatcggctacagcgtgcggccctcggcacgccgccgcggcctggccacctgggccctggcggccgtcctgcacgaggcgcgcctcctggggctggaccgggtcctgctgacctgcgacccggacaacgaggcgtcggcccgcacgatcgagggaaacggcggggtgctggaggacgtccgcgacaccctgatcggccccaagcggcgctactggatcgacctccagtaggggcggggagggtccggacggaaaacggacggcggggccgaggggcggctttcggcgaggccacgggcgagccccgtgtcgttccgtcgctggagagcccggacgggtcgatagtggggtggtgagcgacaggccggagggacccgggcagggtggcggcggggacggcaccgcctggtccggacgcgaaggggcacgggccttcgcggcggtggaggcggccacggactggctcctcggctatcccttcgtcttccgggccctggccgaccggatcggccccggcgaggtcctggtggactacggatgcgggccgggcaaggtggccgacgaggcggcccggcggctgggagcccgggtgctcggcgtggacaccagccctgagatgctggcgctggcccgcggctcggccacggcggtggcggaattccacctggtcgagggcgggcgtgtgaccggcctgccggacggctgcgcggacgcggtcatgtgtaaccacgtactggcgtcgctgccgacccaggaggcggtgctcggcgtgttcaccgagatccgccggctcctgcggccgggcgccccgttcgtcctgctgaccaccgatcccgcctgcggcggcacggagtacgcctcgctgcggatcggcgacccgggcgaggtgtacgggcccggtgacgagctgaccgtacggctgcggcgtacggacgggtcctggcaggaggtacgcaaccacgcgtggcccgtcggcaccctccccgccctgctggagcgcgcgggattccgggacgtcgcccggcgccggcccaccgtcgacgaggcactgaccgtggccgacccggagctcgcggccgggcgcgcgtggtcggcggaacgggcgggaccgcccctcgtggtcacgaccgcgaccgccgcctgacccgacgcgaacggtcctcgtcccgccggttcggtgttaccgtcacgccatgtcgtccaaggccgagatagacgtggtgaccgccgagttcttcggcgccttcgacaaccggggcggcaggagcgccgatctggaccggatccggcggttgaccctgccgaacgcggtgatcaccctcaccggcccgcagttcaccgtctacaccgtggacgagttcatcgagccgcgccgcctgctgctgtccgccggcggccgcctggccgagttctccgagtgggagacctccgaacggaccgagatcgcgggcgacatcgcgtcgcgattcggcgggtaccgcaagtccgggaccctggacggcaagccgttcgagggggccgggaccaagaccatccagttcgtccgcaccgcgcggggctggcggatcgcggccttcgcctggtacgaccagccctgatccgggccccgtcgacaagccctcgcggctgcacggtctcgtacgccgggacgtacgtgtgcgggaaccgcgggtcccacgcgaaacccggccacccgaccactcgccccgtccgccgatgactgcccggcatgtcctctcagcccgcaaacgatcacgaccccggtcgggcaacggtgccgcgcggatcaaccgcgccggacgcccgcgtcactgctgcgcgaggtgtttcctgagcagggcgagcagcgccgcgaacgcgggggtcatggcggcgtccgactgctccagaaccgtcacccgaccgtcgtcctgcaccgtgacggtgtagctcatcgcgtcccgggcggggtcggcccggtccgtatcgggcgtcgcgacggccgccgtgaccagccggaccagctccgccgccgtgtcctcgggcagggtgtccgtgtccagcacccggggccggcggcggaggtcgcccaccgccgccagcccgccgtaggtttccagggtcaccttcatcgcgggcaacctggggtcacctggtgcccttcatcccggccagatccttggccagtaccgtcaccttgttgctcagttgcccgatctgcctgctcagggcttccatgccaccgtcctcccggcccacgccgccgttcccgtcgacggcgaagctgcgggcccgggcgatcccggtcggcacaccggtgatctggacttccacctcctgccacgcggccagcacgatcgactgctcggggctgtcggccccgaacagttccccggccttccggaaggtggtgtcggcgaaatcctggaacgtgtcctcggcgccggacgccttcagcgattcgtaccagatgcttccggcggcctcccatgagaatccgccgatgtgcttggccaccaggtagaacgccttgttcgggataccggagttgtagtgcaccccgccccagtcgccccgcctggtgtcgggcaggtgtacgaactcgctcatgcggtcgggctgggggtcctttccggtcaacggattgtcgtaggcgcttcccgggtccttcatcgaccgcagggcgtcaccaccgatgagcggggtccatacgtcggccccgatcagccagtccgcctcatcggccgtctccttcagcgaccactgcttgaccagcgacccgaagacgtccgacatcgactcgttcagggccccggcctgcttgtggtattcgaagcccgaagtgaattcggtgactccgtgccccaactcgtgcgcgatcacgtcgagggacttggtgaggtcggtgaagtcctgaccgtctccgtccccgaagaccatctgtcgtccgtcccagaacgcattggcgtacttgatgctgtagtggacgtatccgtccaggcgcatcccccgatcgtcgacggaattgcgctggaacgcttccttgaagaaatcgcgtgtcaggccgagcgcgtcgaacgcccggttgacggacgcgtcctccgacgccggcccgtcctccggcctggccagctcggcactggggaggaattccgactgcctgcagtcgaagatggtgcgccgcccgttcccgggcgcggccgcgccggagaaggctgctcggaccgatcgctcaccgcgcaggcgagccgtggtcagcagggtgtccagggcggccttgcgtacgtcaccgtcctcgctctcaaggagcttgtcgaggatgtacggggggatgatgcagttgatcgggtgggtcctgctcatggggcacctcctgagtgagaggaccgacggttgcgcattcaatttgacgtcattggacttcgaggtcgacaattcagggaccggagttgccgggacgcccgacgggtccccggccacgcaaaagccgccgacatggaatccgaccgccaaggcgcggacaggttctcgaagttcaattcggccgatgacgagcgtggcagcagcgaatgaagcgccggagccgctcagccgcgtgtccggcgagggccacgctggtatttccagtctcctgctgtccgtagcggctcgcaaacgcgacgcgagcgcgccggtacgagaccgccgggacgaggccgccgggacgaggccgccggaaccggttgccggaccgcggcggttcagtgttcgccggggggacgctcgtcctggagccggtcgcgctgcaactggtgggcgagcgtgcggcgtaccgacgccgagaacggagccgccgtgccggtgccggccgccgccttcggcgggacgtcgagaccgcggctgatctggtcgtacgcggcccggaagcccggtggcagctccgcgcgacggagcgtcaggtcctcttcgagcaggcgtcgcagctcgtcgacggtccgcggagtgaagcgcttgcggccacggccgagtgcgtcgacgcagcgggtgcagcgcgcggtgtcgagggtctcggagaccgcctccgcgagcccccacaggcgcccttcgagccacggggtgtcgtactggtcgagggtgagccccatcggcggtgcggggtcgtcgagcgcgtacttcgccacctgcttggacacggccggctgactcatgtcggcgatccgggcgatcgtgtcctgggtccagccgaagccggcgaacagcttgatcatctccgcgcgcagcttccgcatctcctcgcccgcgcggatgacctcgttcataccggcgagcatccgcacggcctgttcctcggtcagcgtgccggtcgtccgccgcgcactctctcggtctgccacccctcggttatacaccggggcgcgccctccgtcataacctggttgtacaaccaggttatgactggcaggatcccggcatgcccaccttcaccgcacctgacggaacccggctcgcctaccgcgtccacggcagcggcgacccggtcctctgcgtccccggaggcccggcggactcccgctacctcggcgacctcggcggcctgtccgcacaccaccggctgatcttcctggacctgcgcggcaccggccggtccgcggttcccgaggacacctcctcctaccgctgcgaccgcctcgtcgaggacgtcgaggccctgcgcgaacacctcggcctcgccgaggcggacctgctggcccactcggccggcgcgaacctcgccacgcggtacgtggcccggtacccgcaccgggtccgcaggctcgccctgatcacacccggcacccgggccgtcggcgtggtcgtcacggcggagtgccggcgggagctcgcgcggctgcggaaggacgagccgtggttcccggaggcgttcgcggcgctggaggagatcaccgggggcaccggcagcgactgggatgccatcagtcccttcttccatggccggtgggacgccgcggcccgccgtcaccaggcggcggcccgcccggacaacgcggaagccgtcaccctcttcgcggccgacggtgccttcgacccgcaggccacgcgcgcggcgatcggcggctgcgggagccccgtgctgctgctcgcgggggagttcgacctgaacagtccccctcggtcgacggccgagttcgccgaactgttcccggacgccacgttcgtcgtacagcggggcgcgggccactacccctggctcgacgacgccgaccggttcgtggcgaccaccgccgcattcctggcgtagcgacccctgcggaacccgctcccgggcagggcgacggccccggccggattccccccggccggggccgccatcggtcaggcgcgtcctccgcgcaccgacacgatcaccagagcacgggcaggcgctccgggatgcgcttcatgaagcgggtacgccacaccagctggtcgacgggcacggcgagggcgagctggggcatcttctccagcagcacctcgatggcgatctccgtgtgccgcttgccgagcgcggtggccgggcagtagtgctgtccgccgccgaaggagaggtgcgtgccggcgttcggccggtcgatgtccgcgacgtgggggtcggggtacacgtccgggtcggtgttggcggcctcgaccaggacgagcatgagatcgcccttcttcacctcgacgtcgccgagggtgacgtcctccagggcgagccggggcaggccgtcggcgatcgacaggttgatgcgcaggagctcgtccacggcggccgggatcttctccggctcgttgcgcaaccgctcccacatctcggggtgctggaggagcgagaagatcgccatggtcaggaagcccatggtggagatgacccccgcgccgaagagcgtgacgcccacggtggcgagcatctcgtccgtcaggtggtcgtagtcggggtcgttgcgcagggcggcgagctccgcgatgagaccggtggtggtggggtcgtcgaggcgttccaccatgtaggcgatgtcacggtcccagttgagcttggcgccggtgaccgggcaggccgagttcatgaacgcgatgtcgaggctggccgccaggcgcggcgcgtcggactcgggaatgccgaggatgcggcagtgcaggttctcggcgtacgggttggtgaactggccccgcaggtcgaccggcgccccgtggctcaggaggctgtcgaccagggtggtggcctgggcgcgcatccagtcggtgagcccgtcggtcttcgggttgatcgccttgaggacggccttgcgcagtcccgcgccggtgatgttgcccatgttgttgacgacctcgggcgggatcgtcagcgcgtactgacggggcaccccgggggcggaggtgtccttcaggctgaaccgggggtcctcaaggacctgcttggccagcggataggaggagacgagccaggcctcgtccccggctatggtgcggacccgcttcaccggttcgccgcgcagctcctcgatctccggcgggagctggtcgccgcgtgcggagaaggggaagtcgagcagggtgtcagtgggcatcgggagctccttcggcgggggtgatgatggcgtgaccctggttgcgcgaggcgcgcaggcccgagccgcgtgagtagagcagttccgccatgggcaggagctggtggtagcagttgagggaggacggcacgccgaggatggccggcgtgtcgaggaagagcggcatctcggcgcagacgtactccaggcacacgtcccgctgccgggtggtggcggccttcccgttcaggaccttcgacgagaggaacgcgtcgaccagcttgttgctggtcttgcggaactccgggtcggtgtccagcaggttggtcaggtggctgtggagcgcccggtaggccgggatgtcggtgagggacgacatcgggcgggcgcggagccgggcgccggtggggtcggcttccgcggcggcgttgttcaccttggcgcggacgccgcgcaggttcttcaccgccttccgccgtgcttcgtcctcgccgtagccgagagcctcgtacatctcggccacgtgcatgtcggtgtagatgaggtcgacctgctcgaagttgcgcaggccccagtgggcaaggtcattgacacgttgggccgaaaaataactgttccccggggaaatacctatgacggcatgatcgccttcggtgctgatcacctggcaatgcggggtgtacggccggactgtgaagacttcggttgctgtcgtcaacaggggtcgggtcctttgtgccgctagtcccatggggccctgtgccccgggtgtggcggcgacgtgagggaaagctacccgaactgagagctaccttccatgtcttctgggtagtaactcatctgtcggacaacacggttgacccgggcatctttcgagcgaggccgattcggctctgtcggcggcttgtcgaccgcgtttcacctgctgttgtcggaacggtcaccggaatggaatcggtcggccgaccggaatttctccccgccgaatccccgccgattcccggcccattccggccgattccggccggaaatcggtactgatgggccgtcaagctccgctcgggcagccgggaaatgggcgccggtcagtagtcgagtacggcgaggaccggcgcgtggtcggaggggctgtcgtgcggcgcggccgggtgggttccgtccaccgtcggcagctgctcccggccggtgaagacgcgctccaggcggggcagcagggcctggctcaccaggatgtgatcgatgagttccctctggccctcgaagacgcgggagaaaccgccctgttccaggatgcgcggagcgaggttccacagccgcctcgggtcgccgaggtcggcgtcgtggaatccgccgccaccgatctgcgagcccggcgggccgtacaggatctgtgtggtggccgccttgaactcgtcgttgaggtcgcccatcacgatcacctcgtgcgcgcggccgtcgccctgcaggagctggtcggccacgaagcggatggtgacggcctcggcggcccggcggtacagggcgtacgcggcgtagcgggcgcgcagttgctcgtcgtccgtgctgtgccggttgccggggaaggtcagcagcttggacttgaggtggcagacggccgcaccgacactgtggccgggggccggactccagcgcacgaccagcccgccgcggcccatcctcttgatcatggttccgtcgtcctcgacccggacgggcggcaggtggtcagggaaggccgtgcggtcctcgaccacggtgagcggccggcggctgaggaagccgacccggatgccgcggcggtccgggtgcgtcgacagggcgatgtgccagtcaccgtcgagcctgtcgaccagatcggacagggcctcgtggctgcccacctcctgtacgccgaggaggtcgggcgcgagccggccgatggtggccgcgaggccctccagcttcgcctggtaagtggcctcgtccttggcggcgcagcggttcgagggcgggctgcccgggggcagcgggcggcagaggttctccaggttccacgtaccgatgaccacgctcacggccgctcccgtcgtcagcccgtcctgggcacgactggtttgtggccgggatacacgtggtcgggggtgacgatactggtgaccgcctcaccgaacagggtgctgggctcctggcccttgtactggctgtcggtgttcaggaggatgaccatcgtcgcctgtgccgacggcaggtagacgggcaggacctcgtagccggggatcgagccgttgtggccgatccagccctgcacgtcgaagatgcccagtccgtagccggcacccggaatgtccatcggagtggtcttcaggcgctcggcctgggtcgccggcttcagcagcgtgccggtggcgagggtgcgggcccagctgcgcaggtcctggaggtcggaggccatctctccggcggcccaggcccaggacggattccagcgcgtcgcgtcctcggtcttgcccgtggcggtctggtcggtgtagccgtgcgcgtagggcaccggcagggccgggctcgtcgggaacaccgtgctgcggagcccggccggtcccaggacgtccttggtgatgacctcgtggagcgggcggccggtgatcttctccaccaccaggccgagcaggatcaggttggtgttgctgtagtcgaactccgcccccggttcgaactgcacggggtgcttgaaggagtagtcgagcaactgccgcggtgcgacgtaccgttccggatcggcttggaggttcttgatgaagtccccgtccaggctgtagttgaacagcccgctgcgcatgcccgccagttcccgcagggtgatgcggtcaccgttcggcactcccgccacgtagtcgccgatgtggtcgtccaaccgcaccttcccctggtcgacgagctggaggagggcggtgacggtgaacgtcttcgtctcgctgccgatgcgcacgtggagcgagggcgtcatgggcgcgccggtcgccttgtccgccaccccgaaggaccgtacgtagctgcccttgccgggggcccacagcccgacggtcacgcccggtacctgcgcctcgcgcatgacctgacgcacggccgcgtcgagttgcgccgcgacggccggtgtgagcggcgtgaagcccgtaccggtctccggggaaggggtcgagctcggggtgggggcggtggccgcggtggtggcggtcgtggtgacgggagtggacgaccggggaacggacgccccggacgcggaacccgctgccgccggggctatgagcagtcctgccgcggcggcagccgcgcaggcccggcacagccggagatgggttggcttcacggcatggtctcccgccgtccgagggctcgggcaacaccatcagcctaggtccggccgccccgggtcgcgaggtgagccggggcggcccggagaccctcagggcggcgggagctcgcgcaggcgtccctcgccgacgagggcgacgccgcccccgacacgtaccgagcggatgtcccggccgtggccgtcggcgctgacggtcatcacgctggggcgcccggtgaagcggccctggcgcagcaggctccgctccccggagccgatccggccgtggccgcgcagacaggcggcggcgcacccggcaccgcttccggtcgcgacgtcctccaggagcccgtcgttgctccagtgcctcccctccatggccgcggcgtccagcaggtacgcgaactcggcgccgaggcgggccagcggcgcgtcgagcggttgcgcgacccgggcacgggccagcgcgtcgccgcgtacggggagcaccaggtaccgcaggcccgtggagatcacctccgggggcagagaggggtccagatcgcccggttcgagggcgaagagggcggccaggccgtccgggtcggggcggtcgaggaaggcggccgcgccctggtcgaggaggctcgcgtaccgcccggggccccggcgttcggtggtgacgtccaccggacggtcgggcaggcgcaaggtccaggtctcgtggtccgcggagccgtggagctcgtgcaggaccgcggcggcgccgatgagagggtgcccggcgaagtccagctcgcccgtgaggtcgaagacgcgcgcccgccgggcccgtcgcggccgcccgggtgagtcgtcgcgcacgaggaagacggactcgaagtgccgcaactcctgggtgatcgcacgcatctgagcgccggtcagcgaatcggcctccgggaacaccgcgaggctgttgccgccgtagggacggtcggtgaagacgtcgacgtggtggtagcgcatggcggcgacgctaccgggagcgggggagtgcggccgagtgccgcaaggcggtcagcggccgagcgcggtgcgcagggtgatcccgtggcgggcgcgcaggcgccgcacctcccagaccgacagggcggtcaccgacagcgggccgccgatcatgaacgtgtagagcacctccgggggcgcggcgacgtcggggccgttgaagacctggaaggcgaagagcgaccagaccagcagcggcgagagcagcgccgggagcagctggtgcacgtccgcgacccgcaggcaggtgaagacgcaggcgtagcaggagacgagcgtgtaggggacggagcagatcaccacgatgacggcggcgatccagccgacggccaggacggcgaaggccagggcggaggagatgaacccggggcccgtgatcgccgagaagaagcccttcaggtctccaccgctgatcagttcgcccttgagggtcgtgatggacagccacagggcgaggggcccgctgacgagcagcagggccgcactgatcggcctgcgcagacgctcggcgaagtcacggcgcctgtcgggggtgctcgcgacgaggaagacggtgatgccgatgaggctcccgagtgccaggacggcgcaggcgaggccgagttcgacgagtttgccgaggacgaactcctcgccgccgctgctcagcgggtacgccacgaccagccagacggcggcgacgagaccgagcacggtccgcgcgcgctgcatccaggtgatgagcccgtcctccacgtgctcggccatgggggagtactcgaattccaccgtccaggaccggaagaacgccttcaccgcgccgccggagtccgtccggctcccgaataccgctctggtcccgctcacttgttcctgctcccccgataacgccgtgctccgtaagctccgtggggcacacgagcaccaccacgaacgtcgaacaccttatcgggcggcgggaagtgccgctgcgcggaagacggcgagaccaggacgggccacgacccgaagtccgtcgcttgacatgtgcgcctaggattccgccgtgaccagcgcagaagtgacccggcgacgggtgatgggcttcggcctcggcgccctcgcagggttgccggccggctgctcgggggattccggaccggtagggcggctccggctcgccacgggccccgagggcgggccgtacaacgcgttcgggcaggcactcgcgcgggccgtcgccgcgagcggccaccggatcgagatcgtcccggtgagcacggcggccagtgtggacaacctgcggaagctggacgagggttccgtcgagctggccctggccatggccgacgtggcggaggacgcggtgctggggcgggagccgttcctccggccggccgccgcgaccgcgctggcccgggtctacgtgaactacacgcacctgatcgtccccgcggacggccccgtgaactccgtgacggacctcgccgggcgcccggtcgcggcgggcgcggccggctcaggggtccaggtggtggcggaacgggtcctgcgggcggccgggctgggcggcgcacccgcgaccgcacccgcgcccgtacccgtacccgcatcggcggcggacgagcggcaactgggccttgccgcctcggtgacggccctgcgcgagcgctcggtcgacgcgctgttctggtccggaggggtgcccacaccggccctggcggacctcgcgcgcgagctgacgctgcggttcctgccgctcgacgcccacgtgggcccgctacgggaccgctacggccccgtctacacggtggtcaccctgccggccggggtctacgggctgaccgagccggtgggaaccatcggggtcggcaactacctgctcgcgcgcgccgacgtcccgcagggcgtcgcgcgtgacctgctccaggtggtgttcgacaggtggcgcgacctgttgcgggaggtgacggcgggggcccggctggagccccggttcgccatctccacgggcgaggtccggctgcaccccggcgcggtcgcctactaccggtcggtgtacggctgaggccgcgcctcacccgggcggaggtgacgggagcctcagctccaccagcaggccgtgcggctcgttgcggccgacgtcgagccgaccgccgctgatccgggcgatctcgtcggcgatggccagccccaggccgctgccggggacgttctggtgctccggggaacgcgcgaaacggcgcagcagcagcggcagctgctcctccggcacacccgggccgtcgtccacgacccgtacgacggcggtgctcccgtccaccgagggcgcggcgcgcacctcgacgcggccgtcgcgcgggacgaacttgacggcgttgtcgaggagcgcgtcgaggatccggcccgtcgcgtcgggcagggcgcgtgctcgcaggccctccgcgaggccggtggccaccagttccacccccgcggcgccgaagaccggagtccaggccgtcacccggtcccgtaccttccgcgacacgtcctcgtcgcccagctccgccgtgcccgattccacacgggccagtgccagcaggccgtcgagcagctcctccagccgctccgcctcgtccagcgcgcggccgtgctcggcgaggcccggcccgggtgcgatgtgcggctcgacgttctccagccgcagcaccagcgtggcgagcggattgcgcagctggtgggaggcgtcggcgacgaagtcgcgctggcggccgatggagtcggccatcgcctccgccatggtgttgaagtgctgccgcagatgacgcagctccggtggaccggtggcggacacggcccgggcctgcaggctgccggcggtcaggcgcccgaccgcgcggtccaggtccagcaccgggcgcatcagccagcgggcgatcccggccgcgaccagagccgccgccgcgaaggcgccgaaggccccggcgccgatgagcgaccagcggaccgtcacatcccggcgggaggcgtcggtgggcacggccatcaggaccgccccgctcacccgttcgtcccggcccaccggctcggccaggacgacggtgcgcgggccccacggacgcagggtgggcaggcggtcggtggagcggccggtgagggcgcgccgtcgggcgtccgccccgtcggtggagccgcccgcggagccgcccggggccgaagcggtgtcggtggccgcgttcgtggcggcctccgccgccggcccggacccggcccgggccaccgtcgcacccgaggagtcgaccacgaccaccccggccccgtacagctgggcgtagcggccgatctcggccgagagctccgcccggtcggcggcggtgcgcatccggtcggcgaggtcggcgaaccgcacggcctccgagcgccgttgcaggagcaggtgctcggtgcgcccgcgcgcgtaggcgtcggccagggggatgcagagcagcagcgccgccgcccccatgagcaccatcagtaccgccagcagcctgcgcctcacggcgcgccgtcccgcgcgtcgtcgtcggggccgtcgtcggagccgtcgtcggcggagggcgggtccgggaggccgagctggtagccgaatccccggaccgtacgcaccagccccgagcggccggtcttggcacggatacccgccacatggacgtccagggagcgggaggccgcgaggaagacgtcaccccagatccggtccaggatcaccgcgcgcgcatgcacctcgtccgggcgggcggcaaggaaggcgagtacgtcgaactcgcgtcgcgtgaggcgtactccggttcccgccaccgtgaccgtgcgacccgcgaggtccacctccacatcaccggcacgcacgggccgggagccggtcgcggcggcgtccgaggggtccgggcggcccgggtggggatccgtccggcgccgtacggagtcgatacgggccatcagctcggccatccggaacggcttgaccacgtagtcgtcggcccccgcccgcagtccctgcacgatgtcgcgctcctcgcagcgcgcggtcaccacgatcagcggcgcgtcgcagacggtacgcagccgccgcagcagctccagcccgtccaggtcgggaagccccaggtcgagcaggacgaactcggcctcgcggacgtgccgcaacgcgtccagggcgcgcccgacccggcgcacggtgtgcccgcgctgggcgagggccgtgccgagggcctgggccatgcgatcgtcgtcctcgacgagcagcgcgtgcatggacagtccttcccgtgacccggcgcagcagcttacgggagccggcccgccgggccaccgggccatcgggtgaggatcagtgtgccgcttcggcgggcgccgccgccggccgctcccgcccgcgctcgccgtcgtcctcggcctcggtgcggctcagcgcggcatcgcgggtgtccggcatgagcacgtaggtcacgagggagatcagcgcgcacccggagacgtaccagaagaacatcttctcgtgaccactgttcttgaaccacagggccacgtactccgccgtgccgccgaacagcgcgttggcgatcgcgtacggcagcgccacgcccagggcgcgcacccgggtcgggaacagttcggccttcaccgccgcgttgatggacgtgtaaccggtgatgacgaccagggccagcagggacagcccgagcgcggaccagtacgaggacgccgatccgagcgcggtcatgatcgggtacgtgccgacggtgcagcccaccgcgaacgtgatcagcaggggccggcggccgatccggtcggacagcatgccggcgaagggctgtagcacggcgaagagggtcagcgcggtgaagctgacgagcgtggcggtggtcttctccatgcccgcgctgcccacgaggtacttggtgaggtaggtggtgtaggtgtagtaggccacggtgccgccgagggtgagcgccatgaccagcccggcctgtcgccggtactgccacagggccttgagcgtgccgcgcgtgctgtcgtcgtgggcctcgtcgcccgcggccgacgtctcctccttgaaggcgtcggtctcctgcagccgccgcctcagccagaagacgaccaccgcgaacagggccccgacgaggaaggggatccgccagccccagctctccagctgcgaggtggtcagcgtgtgctgaagggtgatcaggatgccgaggccgagcagctgcccgcaggtcatcgacacgtactggaaggacgagcccaggccgcgccggttccgggcggacgcctcggtcagataggtggcgctggccgcgtactcgccgccgatgctcatcccctggagcagccgcgcgagcaggagcaccagggcgccgaagtacccggcctggccgtaggtcggggcgatggcgatcagcagggcggccaccgacatcatggtgacggtgagggtgagcgcgctcttgcgcccgtgccggtcggcggcacggcccaggatccacccgccgacgggacgcatcaggaagccgacggcgaagatccccgccgtgttcatcagctgggtggtcgggttgtcgccggggaagaacgagtcggcgaagtagatcgcgaagctggcgtagacgaaccagtcgtaccactcgacgagattgccgagcgagccgccgaccagggcgagacggcgcttcctgcgctcgtccccgggcggagacgcgggcatgacgacggacggggacatggcggctccagacggaagtccctgatgagggacggcagaactgccccggcgctgggggagtgtccagagcatgcggcggccgtcggacccggacaaggtccgccacgcagatctaacgttccgctaaggaagctcccgggagagctccggggccgccggatttcaccactccgtcatgcgcacgtcatgcccgctccatggtcgtcacccgggcgtggcccaccgtgggggcggcccgtcgcgggacgccggaggaccccggccaccccgcggccggccccaccccgtaaccccaacaggaggcaagatgcgcgtgatcccgagcaggcggaccccggtcgtggccgcggcggccatggtggccctgggcgtgctcgccgtaccggcgcacgcccggacggaccggggcggcacgtcgccgtcactgccccgggtgacggcctccgtcgagacgccctccctcttcgacgacgaggcgggcggcaacgcgaacgccgacgacccggcgatctggcgcaatgccaaggatcccgacgccagtctggtcatcgccaccgccaaggagggcggcctgcgcgtctacgacctggacggacgccaggtgcagtcgctgcccgcgcccccgccgccgggggacggcgacaagcccggacgcttcaacaacgtcgacctgatcaccggactccgcttccccgacggccgtcacgacgtggccgtcgtctccgaccgcggccgcgaccagctgcgcgtctaccggatcgacccgaagcggcccgcggccccgctggtcgacgtcaccgacgaggcagccgccccgcgggtcttctccaccggccaggacgaggtcaacgaccagcgtaccgcctacggcctggccgcctacaccgaccgccgcgacggccgcgcctacgcggtcaccagccggcgccacgccaccgacctcgcgctggccgaactgctgcccgacgcccggggcaaggtcggataccgcaccgtccgcaccacctcgctgcccgcctccttcaccctgccgaacgggcagaactggtcgccgtgcggcgaacccggcgagcggccccaggtcgagggcatggtcgtcgatcccgacaccggtgacctctacgccggtcaggaggacgtcggcatctggaagctcgacgccgacctgcgcacccccgcccgcctcgtcgagaaggtccgctccttcggcgtgcccggcacctggaaccccgggaccgaggagtgcgacgcgggcgctgaccccggcttcggaggccggcacgtgtccgccgacgtggagggcctgacgatctggcgcgacccgaagcagtccggccgccgcggctacctgctcgcttccagccagggcgacgacaccttcgccgtcttcgaccgcgagcacgacaacgcgtacatccgcggcttccgtgtcggcgacgacgccgcgaagcccggcgtgccggacggctcgcaggagtgcgacggcgccgccgtcacgagcgcaccgctgggcaagcggttcccgaacggcctgctggtcgtccaggacggccacaacacccccgcgaccaccggagcagacggcgagacccgtaccgacaccgacttcaagttcgtggacctgggcctgctgaagcgggccgcccgcctctgaccgcgccgccgcaagcaccctgacctgggcggcgccgcgttcgcccaggtcgataggatcgccaccgcacacgacggaaggcgatcatggcggacagtcccctcaggcccagctcgttgatcaacacggtctacggggcgttcctgcgacgcctcgggggctggatctccgtcgccgacctggtcaccctgatgtccgagctggacgtggacggcccggcggcgcgttcggcgatctcccgtctcaagaagaagggcgtcctcgaaccggagcgccggggcgccaccgggtaccggctcagccccggcgcgcagcccgtcttcgacgagggcgaccggcgtatcttcggcagcctggaaccggcgaagctgagcgacggctgggccatggccgtcttctccgtaccggagtccgagcgctcccaccgctaccagctgcgcacccggctgacgtggctgggattcgggaacatcgccccgggcgtgtggctggcgcccggccgcctgctcggcgacgcccgcgacatgctcgtccggctcgggctcagcgagtacgtgcacctgttcgccgccgagtacgcggccttcagcgacctgcccgggacggtcagctcgtggtgggacttcccggcgatcgaggaacagtacgccgggttcaccgaggcctacggccccgtcgccgccgcactggccgaacagcccgccgtcgacggcgccgaggccttccgccactacgtcccgatgctcacccagtggcgccgcctgccctacctcgaccccggactgcccgccgagctgctccccgaggactggaacgcggtcgccgcacggcagatcttccagcagctgaacgaggtgctcgccgcgcccagcctgcgccacgtgcaggaggtcaccggcctgaccggggcctgaccacaggaccgccaccacccgtcgagcgcgacggcccggggcggaacgcgacgcctgggatcagcgcgggcgggtcggccggggtggccgacaccggccggggttgcgtgccgcgggagggaccgggcgcgaggatgcaggcatggccgacatctttgcttcacgcaccatcgacgtgacgaccggcgaccgggagagcgtccatgacctgaccgacgcctgcgcggcgttcctcggggaggtggcgcggggccggagcgggctgctcaacatcttcacgccgcacgcgaccgccggactcgccgtcatcgagacgggagcgggcagcgacgacgacctcctgaaggccctggggtccctgctgccggccgacgaccgctggcggcaccggcacggttcccccggccacggccgggaccacgtactgcccgcgatcgtcgcgccccacgcgacgctgcccgtgatcgacgggttgctggagctcggaacctggcagtccgtcaccctcgtggacaccaaccgggacaacccccggcgacagatccgcctgtccttcttcggctgctgacccgccctgcgggtcgcaggggtgatgacgtatcaatcatgacaggtcagaggccgttttcgtaggaccgagagcacagcggattgcccttgttcggacccctgtgcggctttcagaatcaccgtcatgactttctcagcgcatgccggtcacgacgccgtactccgagcccgagtcgccctcctgagctcacagaccctgcccgcccggcaggaggtcgcggcctaccgcgtgctcgtccaggtgggtccgctggcgtatctgccgctgctggccgaggcgttgtacgagtacagccgtcaggacttcgcccatctgcccgagaccgcgctggccctgcgggccgaggcggtcgccgccgcccgccgcatgtactccctggagccggccagggaccgcctgctcatcaccgcgctggaccgctaccgggagcagctcgctctcatggaccgtcaggaggaactcgacgccgtggagcgggagatggcccaggtggccaccggctccggcgcgtagcggtccggaccggggggccgcgactcccggtccggcaatgccgggcccgcggccccccgtgccggatgatcgggggaggcgggggaggggggccggggggtgggcgtctacgagggaccggagcgagccgatgcgacaccgaacgcccctgctgtccgtcgtgctggccgcggcggtactggccgccgttcccgggtgcgccggtgccccggccctgcgcggcgcaccgcccgcggcctcctccgtaccggccaccggtgacttctccggccaggtggacgtgggcggcggccggaagctccatctgagctgcaagggcagtggcagccccgtcgtcgttctggaatccggactgcacgactcctcggacacctggaccttcaccgacacccggccgccggtaccggcatccccggcggtgttccccggagtcgcggccttcacccgcgtctgcgtctacgaccggcccggaaccgtccggtacaccgacccgccggcgctcaccacccgcagcacgccggtcgacggcgtccgctccctcaccgcgatggccgacgatctcgacaggctgctgacgtccgcacacctgccgggcccctacgtgctggccggccactccttcggcgggatgatcacccggctgtacgcccagcggcacccggggaagacggcgggcctggtcttcgtcgatgccttcggtacggacatccgcgccctcttcggcgcgcgctgggccgcgtaccgcgagctgctcgaccgccccggcactccgttcgacgcgcaacccgcgttcgagcgggtggacctcgacggcgcgatcgactccgtcacggccgcgcgacccctgccggcggtccccatggccgtcctcagcaagacggagccgttcgccgcccctccgggaaccccgaaggatctcctggacaccctggagcgggcctggccccgggtccagcagaagctggtggagctgggctcccagaccccgcacttcctggccaccgggagcgatcattacgtacaggtgcacgatcccgacctgacgatcagcgcgatccggctcgtcgtgggccgcgtccgggcggagccgtagccccgcccgcaaggggcggggcggggtgtccgggccggccggcggggccggcccggacgacaggaccggtcaggcgaggtcgaaccggtcgaggttcatcaccttgtcccaggccgcgacgaagtccttcacgaacttctccttcgcgtcgtcgctcgcgtagacctccgcgagcgcgcgcagctccgaattcgatccgaagacgaggtcggcgcggcttccggtccacctgacccggcccgtggccgagtcgcggccctcgaacgcgttcgcgtcctcggacgtcgccgaccacgtcgtgcccaggtcgagcaggttgacgaagaagtcgttggtgagggagccgggggtcgtggtgaggacaccgagcggcgtgcgctggtggttcgcgcccaggacgcgcaggccaccgacgaggaccgtcatctcgggggcgctgaggttcagcaggttcgcccggtcgatcagcaggtactcggccggcagccggttgcccttcccgaggtagttgcggaacccgtcggcggccggctccagcgcggcgaacgactccacgtccgtctgttcctgggtcgcgtccgcgcggcccggggtgaagggaacctggacggcgaacccgccgtccctggcggcctgttcgacggcggccgcaccggccagcacgatcaggtccgcgagcgagatccgcttgccgccgctctgggcggagttgaaggactcctggatcccggtcagggtgcgcagcaccccggccagctggtccgggtcgttgacctcccacccgctctgcggctgcaggcggatccgggcgccgttggcgccgccgcgcttgtcgctgccgcggaaggacgaggcggaggcccacgcgacggagacgagctgggacaccgacaggtccgaggcgaggacctgctgcttgagcgcggcgacgtcggccgcgtcgacgagttcgtgcgtcaccgcggggagcgggtcctgccacagcagcgtctcggccggcacctcggggccgaggtagcgcacgaccgggcccatgtcgcggtgggtcagcttgaaccacgcgcgcgcgaaggcgtcggcgaacgcggcggggtccgcgaggaagcgccgcgagatctgctcgtaggccgggtcgaaccgcagggagaggtcggtcgtcagcatcgtcggggcgtgggccctggacgggtcgtgggcgtcgggcacggtgcccgcgccggcgccgtccttcggccgccactggtgcgccccggccgggctctcgaacagctcccactcgtagccgaacaggatctcgaagaaggtgttgtcccaggtgatcggggtgttggtccagatgccctcaaggccgctggtgattgcgtcggcgcccttgccggtgccgaaggaactgctccagcccagcccctgcgcctccagcggggcggcctcggggtcggcgcccacgctctccgccgggcccgcgccgtgggtcttgccgaaggtgtggccgcccgcgatcagggccaccgtctcctcgtcgttcatcgccatccggcggaacgtctcacggatgtcgcgcgccgcggcgatcgggtcggggttgccgttcgggccctcggggttgacgtagatgaggcccatctggaccgcgccgagcgggttctccagctcgcggtcgccggtgtagcgctcgtcgtcgagccaggtggtctcggggccccagtagacgtcctcgtcgggctcccagacgtcggcgcggccgccgccgaagccgaaggtctcgaagcccatcgactccagcgccacgttgccggtgaggatcatgaggtcggcccacgagaggctctggccgtacttctgcttcaccggccacagcagacggcgggccttgtccaggttgccgttgtccggccagctgttgaggggagcgaaccgctgctggccggccccggcgccgccgcggccgtcgctgatgcggtaggtgcccgcgctgtgccaggccatgcggatcatgaacgggccgtagtggccgaagtcggcgggccaccagtcctgggagctggtcagcacgtccgcgatgtcccgcttgacggcggggagatcgagggtcccgaacgcggcggcgtagtcgaacccctcgccgagggggttcgcgacggcggggttcttggcgaggatccgcaggttgagccgttcaggccaccactggcggtttccgccgccctgggtcgggtgcggggcccgcccgtgggctatcggacagccttccccgccctccggcttggcatctgtgacgattgcatcgtggttctcagacatgggaatccttccgtaccaggcggatcacggtgttcaggaactgaatgcgactgagtgcgactgaaatacgactgaaatgcgaccgaagcagtgcatgggctcggccccgtcgatcgccacgacgccgagggtcaccgtcccggacggttgcgggcaggtgggacaccggcggcggccgtccttgtcgcctgccgccctcgggtcttcccgcctcttggccaactgcgtaaccgatcctacgatggacggaatccaagtcaagacggacaccaggtcccggtgcaatcgaatcccggatgtccgccaataaacttcggggcaccccgtcgaacctgaataggtgggccgatatgagtgacctgctggagcgtttgcgcgggcgtggctggcggatgacgtcccagcggcgcgtcgtcgccgaggtcctggacggcgaccacgtgcacctcacggcggacgaggtgcacgtccgcgcggcgcggcggctgccggagatctcccgggcgaccgtctacaacgccctgggcgaactggtcgccctcggcgaggtcgtggaggtcaccaccgacggccgggccaagcgctacgaccccaacgcgcaccatccgcaccagcacctggtgtgctccgcctgcggcctcatccgcgacgtccacccggcgaacgacccgctggccggcctcccggcggaggagcgcttcggcttcacggtgtccggggtcgaggtcacctaccgcgggctgtgtcctgactgcgcgtagccgcgcgcacgcccgcgatccgcagccgctttaccgtctcttcccagccacgcgcaaggcttcaacaagaaaatccttgatggcgcactagactggtgggttgtttggcgctggtccggaacaacctgggcagacccgggctccgccggcgacccggatgcaaccgggaacgagacgcgagggccgatggcagtcacacctgagcgcggtgaactcactctgctcgacgacgcggagacgctggaggaggccggcaagtccgcccgcttcaccgccgggcccgccgcccccacccgcaccctcgtcgacgtcttcgaggcgaccgtacggacgcaccccgacgagctcgccctcgacgacggcaccacccgattgacctaccgggcgctcgccgccgaggtcgagcgccggcgccgggccctcgccgccgccggagtcggactcggcgaccgggtcggcgtacgcgtgccgtccgggaccaacgagctgtacgtggccgtcctcgccgtcctcgcggccggcgccgcctacgtacccgtcgacgccgaggacccggacgagcgcgccgacctggtcttcggcgaggccggcgtccgcgcggtgctcggcgggggacagcgcatccactccggccgtgccgcggaatccggcgcccgcgccgccgcctcccgccccggccccgagcacgacgcctggatcatcttcacctccggctccaccggcaagcccaagggcgtcgccgtcagccaccgcagcgccgccgccttcgtggacgccgaggccgccctgttcctcgccgaggagcccatcggccccggcgaccgcgtcatggccgggctctccgtcgccttcgacgcctcctgcgaggagatgtggctggcctggcgctacggcgcctgcctcgtgcccgtaccccgctcccaggtgcgcagcggcgccgacctcggcccctggctcgtggagcaggagatcaccgtggtctccaccgtgccgaccctggccgccctctgggaacccgaggcgctcaacgaggtccggctgctgatcttcggcggcgaggcctgcccgcccgaactcacccagcgcctggtcaccgaaggccgcgaggtctggaacacctacggccccaccgaggccaccgtcgtcgcctgcgccgccctcctgaccggtgaggagccgatccggatcggcctcccgctgaacggctgggaactggccgtcgtcgacgagtccggggagccggtccccatgggcggcagcggccagctcgtgatcggcggcgtgggcctcgcccgctacctggaccccgacaaggacgccgagaagtacgccccgctcgaatccctcggctggcagcgcgcctaccgcagcggcgacctcgtacgcgccgaaccggaagggctggtcttcctcggccgcgccgacgagcagatcaagctcggcggccgccggatcgagctgggcgaggtggacgccgcgctccaggccctgcccggcgtcgcgggcgccgccgccgccgtccgcaccgcccgcagcggcaaccagctgctcgtcggctacctcgtcacccaggagggctgggaccacgcggcagccgtcacgcggctgcgcgccgagctgcccgccgccctcgtcccgctgctcgcacccgtcgccgaactgccgacccggacctccggcaaggtcgaccggaacgcgctgccctggccgctccccgaactggagacctccgggcccgtcgaacagctctacgggaccgaggcctggctcgccgagcagtggagcgaaaccctcggcgtgaccgtcaccggcgccgccgacgacttcttcgcgatcggcggcagcagcctcgccgccgcccagctcaccacccggctgcgcacccgctacccgagcgcggccgtcctcgacatctaccagcagcccaccctgcgcaagctggcccggcgcctggagaaatccgtccaggacgacaccgcggcccgcaccgtcgcaccggtcccgccgcgctcccaggtggcgcagtcgctcctgctggtcccgctgttcaccctggtgggtctgcgctggacggtgtccctgctggccctgggcaacgtactgcaccacttcgggcccttcccgtgggcgccgaccgcgtcgtggtggctcgtcgccgccggcgcggcgctgctctacagtccgccgggccgcctcgcgatcgcggccggcggcgcccgccttctgctgcgcggggtgcaggccggacgtcacccgcgcggcggcagcgtccacctgcggctgtggacggccgagcggctcgccgaatgcgccggagccacctccctcaccggctcctggctcgaacgctacggccgggccctcggcgccaagatcggccccgaggtggacctgcactccctgccccccgtcacgggcatgctcaaactcggccgcggctgcgccgtggagtccgaggtcgacctctgcggccactggctggacggggaccacctggagatcggcgcgatcaaggtcggcgcgggcgcggtggtcggcacccgcagcatcctcttccccggcgcgcgcgtcggaaagcgcgccgaggtggcccccgggtccgccgtcgtcggacagatcccgaccggccagcgctgggccggcgcacccgccgggaagctcggcagggccaagcacaactggcccaaggaacgcccgccgcgcggcctgccctggcgggccgcctacggggcggccggcttcggcctcacggccctgcccgtgctcgccgccgtccccgcgctgctcgtggcaggccgcttcgtgcccgccgacgccgggctcaccgaagcactgcgcggagcgctgctcgccgtggtgcccgcggcgctcgccttcgggttcgcgtacgcggccctgctgctcgtctccgtacgactgctcagcctcgggctgcggaccggaacccatccgacgcacagcagggtcggctggcaggcctggacggtcacccagctgatggacctgtcccgcgagacgctcttcccgctgtacgccgggctgatcacaccggtgtggctgcggctgctcggcatgaagatcggccggggcgccgaggtgtccaccgtgctcgccctgccgagcctcaccaccgtcggcgagggcgccttcctcgccgacgacaccctgaccgccccctacgagctcggcggcggctgggtgcgcatcggccactccgagatcggccgccgcgccttcctcggcaactccggcatgacggccccgggccgcaccgtccccgacgacgggctggtcggcgtcctgtccgccaccccgaagaaggccaagaagggcagctcctacctgggactcccaccggtccggctgccccggtccaccgcggacgccgaccagagccgcacctacgagccgcccgcgcggctgctgtgggcgcgcggcctggtggagctgtgccgactcgtcccggtgttctgctccgcggccctggccgtgctgaccgcggcggcgctctgcgccctgaccacgcgcgccggcctgggtctctgggtcaccgcgctgctcggcggattcgtcctgctcgccgccggactggccgcctgcgtggtgtcggtgacggccaaatggctgctggtgggccggcaccggacgggggagcacccgctgtggagcggcttcgtgtggcgcaacgagctggccgacaccttcgtggaggtactggccgtgccgtggctggccggttcggtgcccggcacgccggttctggccctgtggctgcgcgcgctcggcggccggatcggccggggcgtgtggtgcgagagctactggctgcccgagacggacctggtggtgctgggcgacggggtcagcgtgaaccgcggctgtgtgttgcagacgcacctcttccacgaccggatcttgaggacggatactgtggtgctccgcgagggcgccaccctgggcccgggcggaatcgtcctgcccgggagcacggtgggggcccggagcacactgggccccgcatccctcgtgatggccggggaatccgtccccgccgacacccgctggctgggcaatccgatcgaggcgtggcggtcctgaccggaccgcaggcgccgcggcgggcggcagggcggcgccggcacaccggtaccacagcacgtcgtacgagcacagcgcagggagcggaagcggcagtgagcggccagagaacagagccttcggacccgtacttcccggccaacggcgactcccgttaccgagtgcaccggtacgaactcgcactggagtaccgtcccggtcccaaccggctcgccggtacggcccggctcagcgcgatcgccgggcgggcgccgctcgccgagttccacctgaatctggccgagttcagaataggccgggtcctggtgaacggccgggcgccgcactacacccaccgcggtggcaaactgcgcatccgcccggccaagccgctgtccgccggctccgccttcaccgtcgaggtgcactgggcgggcaaccccaagccggtgcgcagcccctggggcggcatcggctgggaggaactgaccgacggcgcgctggtggccagccagcccgtcggggcgccctcctggtacccgtgcaacgaccggcccgccgacaaggcctcgtaccacatctccgtcaacacgccctccccgtacacggtcgtggccggcggccgactgctcacgcgcacgacgaaggccagcacgaccacctgggtctacgagcagtccgcgccgacctccagctacctggtcagcctgtccatcggcatgtaccagacggtgctcctcggcgaccccggcctcggcggagtcccgcagagcgcgcacgtgccggcgcacctcctgccgcgcttctcccgcgacttcgcccggcagcccgccatgatggccttgttcgaggacctcttcgggccctaccccttcggcgagtacgcggtggtcgtcgccgacgaggaactcgacgtccccgtggaggcacagggcctgtccaccttcggcgccaaccacgtggacggagtccgcggctcggaacgcctcatcgcccacgaactcgcacaccagtggttcggcaacagtgtgaccattgccgactggcggcacatctggctcaacgagggcttcgcgaaatacgccgaatggctctggtcggaacgctccggcggccgcaccgcgcacgagctggcgaccgccgcacaccggctgctggcctcgcagccacgggacctgaggctggccgaccccggccgcaagctgatgttcgacgaccgcctgtaccagcgcggcggcctcaccctgcacgcgatccgctgcgcgctgggcgacagcgccttcttccgcatgctgcgcgactgggccaccgtgcaccgccacggggtggtgtccaccgtggccctcacccaccacgtggcccgctacgcggccgagccgctggacgacctgttcaccgcctggctgtacgagcccgccctcccgcccctgccggcgccggcccgccccgcgataccggcgagacccggatacccgccgacgaacgccggctccaaggggggccggggcaagacaccccctaggtgaggggcatccgggcccgcacctgccagtcgccctcggcggtggcctcggcccggaaggtgccgccggccagggtgacgcggtctcgcagatccttcagcccgtaacccgggcgggaggtccggtgggccgtgccgtcgttggtgatccgcacggcggcctcgtggggacggacgcgcacgtggacgctgacgtggcggcagtggcgggcgtgctcgcggatgttggtcagcgactccaccgtcacccggtgcagggtggcggccacctcgggcggaacggtgtccgtcgggccttcctcggtgaggtgcgccggtacgccgttcagggcgaacccgcgcaccagcgcccgcaggtcgtccatgtcggcgggcgcggccggcgggacgtcgctctccccggccctgagcccggcgaccatccgccgcatggacgcgagcgcctccgtgcccgtctcctcgatgcgctgcagggcaggcgggaccaggtcgggccgcctggcggcgaccgcccgggcgccctgggcctgcaccacgatgccggtcatgtggtgggcgacgtagtcgtgcagatccccggccagctcgatgcgttgttcgaggcggaggcggtgtgcgcgctgccgccggtcggccaccacccaccgcgcggtcacgctcgcccccgccaccagggcggtgaccagcgtgaggccgagagcgacggcaaggctccgctcctgcacgccgatggacagggggcgcagcacgacggccgccgccagcagcagggcgacgggtccggcggaggccgccgggccccgcctggtgacgaaggccaggacgaccaggagggcgaccggctcgaacgccccgtggacggccggggtgccgagggcgtcgtggcccaggtgtacggccgcggagccggccagcgaggcggtggcggcgacgccgccggcgtacgcgtacgaccgggcttcgctgagcaggggcagggcgaggaggaccgcgcccacgacgacggccgacagcgtgagccgttcctgcggggccggtccggtgaacgaccaggccggcgcgtccgaccagaccgcggccgcgagcgcacacgccgcgagggaccgcagcaggaccgccgcctggccggaagcggcgaggaagcggaggagaggagaccacatagcgcgcagattagatcatcggggcgcccggtccctccgccaaaagtcgtagtcgcgcgggccgggatctgcgctgctctcgctacgcttccgtagggattcggggagtggtggccacccgtgccgagcggcccgcgggtgagcggccgtgacaggctgtcacgggattcagggcatgtctgtgccgtcggattcgccgcgcaggacacagaattcgttgccctcgggatcggcgaggacggcccagcccgtgccgtccggctgccgccggtcggcgaccagtgtggccccgagaccgagcagccgctcgacctcctcctcgcgcgaggtcgtcggacgcaggcacaagtggatccggttcttgaccgtcttcggttccggcacctggttgaagtacagcagcgggccctgcgcaagcatgaccacggtctcccggtcacccggtctcgtctgcggatgcagcggacaaccggtcacttcaccccagaaacgggccaattcatacgcattcgaacagtcgatcgccacgttctgcaccacggaaaccatgcggctcagcttgcccgagccgtatgcgggccgccacccaaatcggcctaggccgatttcgtccagcgctgtgatgcctgtccgccgcaggtgttcgtcaccaggccgccgctcatgcccaggtcgaggcagcccccgctgaagtcgttgcggaggctgccgcccgcccccgtacgccagagccgggcggtgccctgggagcagtcgccgacgaagacggcctggccgagcatgttggcgtacaggcagccgccgccctgctggttgaccagttcgaagctgccgtccggcctgctccgcacggtccaccgggcgctcgcgtccgcgcagtcgccgtagtccgaggccccgaagacctgcgtgacgcacttgccgttgttgccgttgcggaagcggtaggtgccggacgcgggaggcgctgggggggccggcgtcgtgggcgccgtggacgtcccgccgttggaggggcgcgtgccgccggagccgcccgcgttcgcggggttgcccgagtttccggcgctgcccgggccgggctgtgtgccgccgccggggaggggtccggtgccggtcccgcccccgcccacacctccgccctggcctccgcccgcgcctccggcggccgctgccgggggtccgcccgtaccggcctgtcccgggtcctgggcgggcggctgcgcgggcgacgccgtacccgacgggccggtgcccgccgtgcccgccgctgccgccggtgccgtcgggccggccggtgccgtgaccggggtggacggggaggtcccggcccgggcctgcggcgcggaggcgtacggcaggtgctggatggcgagggtggtaccgcccgcgaccacgacgacgggcacgacggcgaggaggacgcgggtacggcggcggcgcgtcgcccgttccgggcgggccgtgaccggaggagcgggggccgcgggagcggacggacccgggtcctccggggtcttgccggtacccggctccggtcgcggctccggttccgcccgctcgccggtgagcgggacggtcggtacgtcggcctcccgcacgtccgcggcgaaggcggcccgctcggccaggcgctccgcgacggccccgggccacagcggggcggcgaacggaccgtgcccggcggcacgttcgaggagttccgcggcggtgggccgcccttcggggtccttgtcgaggcaggccgcgacgagttcggcgaggtccggctccagctcccgcagcggcgccaggtccggctcctcgtggacgatgcggtacagcaccccgtgccccgactcgtcgccgaacggaggccggccgcaggccgcgtacgcgagtacggagcccagggcgaacacgtccgtggctccgctcaaccgccttcggcccgaggcctgttcgggtgccatgtacgcgggcgtacccacgaccatgccggtgcgggtcagctggctctgctcggcggcccgggccacgccgaagtcgatgagggtgagaccgtcgagggtcagcatgacgttggacggcttgaggtcccggtgcaccatgtccagcgcgtgcaccgccgcgagtcccgccgcggcctcccgcagcagcagccacagcgcctccgcgggcagcgggccgccgtgcagcgcgacggcctccctcagggtgagcccggggatgtacgcggtggcgaaccacgggggagtggcggtgcggtcgctgtcgagcagcggcgcggtggcgtccgcgggcagccgggcgagattgtccaactcgtggccgaagcgccgcaggaagtcctggtcctccccgacgacggaggacagcagttgcttgacggcgacgtaccgtccctcgcggaccccgaggtagacgcgccccatgccgccggccccgagccggcccgccagcgggatcgacccgatccggtgcggatcccccggctccagcggctcggccccgctccccgtcagctctaacacgtaagccccgctcgaattagaaacagtttccagaaataaatctaaccccgatgatcccgggacggcaacgcaggccgccgaaggccgagttgatcccggtatcggcccggcatcgccccggcgaagcctcgggtggcatccccgcgcaccccgcctgggtcgaccgccgggccccactgcccgcccccggcaacggtgggataatccagttggggagacagatgtgacgcactcggatcgagaagctcgggcgactcgaagggaggagcgtggtgagcacccccgccgctcgcatcgctgacctgctggaggacgtgccgacggcctcgaacccgcccgcccggttccccgctccggcccccgacccgtcgccgcgcaccgatggtccaacgctcaacatcagcgtgatctggggcgacatcgcgcggatcgcggccgatctgcacgtcacgggtcactaccagtcggtagtacccgccgccgcggaactcgccctcgaccgggctatctccgtcgacccccgccgcatcatcacggagcacaccaagctgggctggatcgaggcccagttgggcgaggtcacgtacttcccgtgcaaggagggccccgtgcgctgcgcggcggtcgtcggcatgggaccgatgggcacgctgacggaacgccgcgccgtccagatgtacgcctccctgctcggcgaggccctcgggctcggccacgtcgccaccctggccaccgtgctcatcggctcgggcacgggcaatctgaccgtcaaacaggcggcccgcgccatcgtccggggattcgccgacaccctggctccgctgggcccgccggcgccgccgccccggctcaccgacgtactcgtcatggaggtcgaccggctgcgcgcggagcagctccacctcgccctcacggaatccgccgcgaagctcccgcaggtccggatcgtccccggactgcgcgaggagagcggcggcgagctgtgcggtccctccgccgcggtgtacgccctctcggcgctgaccgggctcgccgggccgccgggcgcgggcgaggacgtgctgcacaccgtgctggccggcttcgacgccgacatccggggaaagatccgcgagcagctcgcggacctggcctcggtggaacgcaccgagctgtccctgacggtccgcagacccgcggaggcccaggacgactcggtgcccgtccggatgtccgtccagtcgggcgtcggcggcctgcgctgggcggccctgaccgggcgggccaccgtaccggagcgcctcgtaccggtggacatggacctgctgcgggaactcgtggaccggctgacggaaccgagcctcaaggacgcgtgcgaactgcccgacctgctgtcccggttcgtggtgccgccggacttccagcgactgctcacggacgactcgacggtgctgctggaactggaccgggacacggcctccgtcccctgggaattcctggccgagatccagcaggccggggtggagaagcgcgaccccctggccatccgtacccagctgtccagacagctgcggacgacctattcgcgggtgatgaccgagggcctggcggacggaccgctgcgcgctctggtgatcggagaccccggagacccggagaagggtttccacctgccgggagcccgccaggaggccctcgcggtggcctcccggctcaaggagctcggagccaaggtcagcctcttcgtcggcgcggcgaacgcgctgcgccagccgggcatcgaccccgcccgccgcctggacgtgctgcgggtcctgctgtgcgggggcaaccacatcgtccactactgcggacacagcgacttcgatctctccggtacgggacggcgctcgggctgggtcttcgcggacggcctgctgaccgcccaggaactggcgctgctcgaacgcccgccgctgatcgtcgtggccaatgcctgctacacggcccggctcggtgacgccggcggccccggcacgccggccgggacgcccggcctcgcgggccgtagcccctgggggaacccgcaggccgcgctggtgccgagtctcgccgacgagttcctgcggatgggcgtggggcacttcatcggggcggcctggcggatccccgacgaccaggggatctccttcgccgaccagttctacacgcacctgttcaagggcgggccgggtgaggcggccccgacggtgggcggcgccgtccgcgcggcgcgcaggcgcctgtacgggctgcgcgagcagggccctgacgcccccggcgcccccgacggtccggacggccccggcggcccggacgccgcgccgagcgggcagcgctggagttcctgggccgcctaccagcactacggggacgcggccgatccgttcgtccgaccggggggcacaccctaggaggtccgctcatggccaggatcccgatggccgacgtggtcgtactgctccccggtatcggcgggagcgtgctgacccggaacggcaaggacgtgtgggcgccgtccgcctcggcggtactgggcgcgctgtcgagcctgggcggctcgctggagtccctcgaactcggtgaggacgactggctcgtggacgatctcggcgacggggtcgccgccgaacgcctggtgcccgatctgcacaccctgcccggcctctggaagatcgacggctacacggcgatcgagaagttcctgctggcgcggttcgacctgcagaagggccggaactacttcccgttcccgtacgactggcggcgcgacaaccgggccgccgcccgcaggctcgccgagcagagcgccacctggctgcgggactggcgcgcggcgagcggcaattccgcggcgcagctcgtcctgatcgggcactcgatgggcgggctcgtctcccgctacttcgtcgaggtgctgggaggctggaaggacacccgggccatcgtgaccttcgggaccccctactacggctcgctcaacgccgtcgagttcctctgcaacggcttccagaagcggatcggccccttcgagaaggacctcacccgcctcctgcgctccttcacgggcctccaccagctcgtaccggtctaccggtgcgtctacgggccggacggtacggcggtcacccccgccaaggccgggctgcccggctggcagccgcagtggagcagccgtctcggcgacttcttcggtgagacggagcgggcggccaccgccaaccggcaggaatccgcctgggaatccaaccaggtggtctaccaccccgtcgtgggcatggaccagcccacccggcagtcggcccggctcgtcgaccacaaggtcgagaccctgatgctccgcggtgacgaggacgagggcggcgacggcaccgtgcccaagctctccgccgccctctccggtaccgaggacgcccgtaccttcgtaccgcagaagcacgggagcctgcagaaccagggcgcgatgctcgaccacctcggcggcatcctccagtccctgcacgacgtccgcatcgacgatctgcgcgccgccgtgacctcgtggttcagctacctcggcgacgatctctacctggccgacgagcccgtcgcctgcgagatcggcgccgtcagcgaactcggcgaggacgcactgcccgaggtgccgtcgcgactctcggtgaccgcgcgggccaccggacagccggtggtcgcccgcgacctcacggtcccgcggcggcggcggcaggtcgagatcggcgtgctgccgccgggcacgtacgacctcctgatcagcgccggcgccgacacggccccgctgtccgacgtcttcgtcgtcgcaggtccggagggtacggacggtacgcgcgtgacggagggctgagggccgtcgggtcagccgccgaccgagacgagaatcgtgacaacgattacattccgccccaaatagcccatccagcagggatcattatttcccgtaattgtcgtatatggctgccattgcggcccgcgccgcccgagggaccggtcggcgccacgggagagatatgggacgcgtgcgcagctggacggtcaaccgacggatcgctctgccggtggcggcggcgggagccgtcgtgctcggagtgggcggcctctacggaaccgccctcgcggtcggaggcgacatcgagcagggcacacgggtcctgggcgtggacctcggcggcatgagccgggccgaggcgcgccaggcgctgacccgggagctcgggcccgccgccgcggcgccgatcaaggtgaagatcggcgaccgggtggagcaggccgatcccgccgcgctgggcctctcgctcgacaccgacgcgaccgtcgaccgcgccgcacggtccggatacggtccggtcaccgtggtcggcagtctcttcgcctccggcagccgcgacgtcgcgcccgtgatcaccatgaacgagcggacggcccgtgccgcggtggaccgcctcggtgagagcaccgagcagcgggtccgcgacggcgcgatagcgttcgacaagggcacggcgaaggccgtcaccccgctccccggcgtgtccctcgtcgaagagaaggccgtcggcaccctgcgggacgcctatctgcggccgcagacggatcccgtcgtcctgccggtgacgcgcaccgagccccgcgtcggcgccgaggagaccggacgggccatgcggcagttcgccgagcccgcgatgtccggacccgtcacgctcgccgtcgccgacaggcgcatgtccatcacccccgcggtcctcggcgaacacctgaagatgcgggccgacgcacagggccgcctcgtaccggacctcgactccaagagcctgctcgccgaccccgccgtggccccgacgatcgacgaggtcagccgcccgccgcggaacgccgcgcccggcctcgccgcggacggccgcgtcgtgatcgccgaccagggccgtacgggacgcaaggtcacccaggaggcgctcggccgggccgtgctgccgctgctgacccgctcgggcacggcccgcagcggcgaggtcgcgaccgtggccgtccagccggacctcaccgccgacgaagcgcgccggctcggcatcaaggagaaggtctcctccttcaccgtggagttcccggccgccccgtaccgcaccaccaacatcggccgcgccgtggagctcatcaacggctccgtcgtcatgccgggccaggagtggagcttcaaccgcaccgtcggtgagcgcacccccgagaacggcttcgtcgacggcatcatgatcaacgacggtcagttcgtgaaatcgcccggcggcggtgtctcggcggtcgccaccaccatgtacaacgccgcgttcttcgcgggcgtcaagccggtcgagcacggcgcgcactccttctacatcgagcgctaccccgagggccgggaagccaccgtggcctggggcaccctcgacctgcgctgggtcaacgactccggccaccccctgtacgtccaggccagctcgaccgacacgtcgctgacgatctccctcctcggcacgaagaagtacgacgagatacgcgcgaccaaggggccgcgcaccaacatcacgccgcccggcaagcggaccggcagcggcgacacctgcgaggtccagacccccctggagggcttcgacgtcaccgtcggccggaccttcgtccagggcggcaaggaagtcaggcacgaggacttcaagacccactacacgccgcgcgacgaggtcacctgcaccccggagggcgcgccggaggcctctcccggcgccacgcccggcaccacgcccggcgccaccgggcagacgccgcagccctcgcagaccccctccggcacggccgcgaacggcgtccggaccgcggcccagggccacagcgactgacgccatcgggggaccaggcgtgacaatccgggcgcataccgtgcatgccgggggccgtgggcgcccggaagtgctacaactgggttcgtgaccattcctcgccacccgtgccgggcacgtcggtgcggtcacctctaggcaaccggaacaagagcgtcgccggacaggtattcgtcctccaggtggcgatcgtggtgttgctcgcggccggggccctgctggccctggtcctccagtcgcgccacgacaccgaacgcgaggcacgcaaccggtcggtgtccgtcgcccagaccttcgcccactccctgggcctccaggacaccctcaagacgtccgacccgtccaagacgctccagcccctcgccgagaccacgcgcaaggccgccggggtggacttcatcgtggtgatggacaccaacggcatccggtacagccacccccagccggaccgcatcgggaaacgattcgtcggcaacatcgagccctcgctgaagggtcaggtccacaccgagagcgtggacggcccgctcggcaaggagatccaggcggtcgtgccggtcaccgggcccgacggcaaggtcaacgcgctggtctcggcgggcctcaccgtcaagaacgtcaccggtgtcgtcgaccgccagctcccggtcatcctcctggccatcgccaccggcctcgccctggccaccgtgggcaccgcgctcatcagcagacgcctgcgccgccagacccacgggctcggcacgcaggagatgacccgcatgtacgagcaccacgacgcggtgctccacgccgtccgcgaaggggtgctgatcaccgacggcgaaggccggctcctgctcgccaacgacgaggccaaacgcctgctcgggctgccggaggacgccgacggacgccacatcgccgacgtaccgggcctggaccgccggatggcggacctgctgctctccggccgcgaggccaccgacgaggtcctggagagcggggaccggctgctcgtcgtcaaccagcggcccacccacccccgcggccggccggaaggcgccgccatcaccatccgcgactccaccgagatgcaggtcctgaccagccgggcggagaccgcccgcagacgcctgaagctgctctacgacgcgggcggcgacatcggtaccagcctcgacgtggtgcgcacggccgaggagctcgccgccgtggccgtcccccgcttcgcggacttcgtcaccgtcgacctggcggaccaggtcatcgacggcgaggagccccgcgcgggctccgacatgcgccgcaccgcggtcagcggcatccgctccgaccatccgctctaccccgtcggccggctcatcgacttcctgccgtccaccccccaggcacgcggctacggcaccggccgggccgagctggtaccccacctggccgacgcgccgggctggcaggcccaggacccgccgcgcgcccaggccatcgtggactacggtatccactcgctcatcgcggccccgctcatggcccggggcgtcgtcctcggcgtggtcaacttctggcggtcgcagaagcaggagcccttcgacgaggacgagctgtccctggccgaggaactcgtcgcccgcgcggcggtcagcatggacaacgcccggcgctacacccgcgaacacgccctcgccgtgaccctccagcgcagcctgctgccccgcgccctgcccgagcagagcgccatggacgtggcgcacttctacctgccggcgcagtccggggtcggcggggactggttcgacgtgatcccgctggccggctgccgcgtcgccctggtcgtcggagacgtggtcggacacggcctgcacgccgccgcgaccatgggccgcctgcgtacggccgtgcacaacttctcctccctcgatctgccgcccgacgagatcctggcccgcctggacgacctcgtacagcgcatcgaccacgacggcgagggcgacgacgtgaacggcggcgtactcggcgcgacctgcctgtacgccgtctacgacccggtctcccagcgctgcacggtcgcgcgggccggccatctgccacccctggtggtcgcccccgacggcacgaccgagatcgtggagctgcccgccggacccccgctggggctgggcggcatgcccttcgagaccgcggagctggacctcgcggaaggcagccagctcgtcctctacacggacgggctgatcgaggaacggacccgggacatcggcgaggggctggaactgctgcgcgccgccctcagccaccccgaccgggacccgcacgagagctgccgggccgtgctcgacatgctcctgccgccccggcccaccgacgacgtggccctgctcatcgcacggacccggacgctcggcccggaccgggtcgcccagtgggaggtaccgttccagccgagcgcggtcggcgcgatgcgcaacgccgccgcgaagaaactcgacgagtggggcctgggcgacctcggcttcgccacggaactgatcctcagcgagctgatcaccaacgccctgcggcacggcagcgcgcccgtacgggtacgcctgctccacgaccacaacctgacctgcgaggtgtgggacggcagcagcaccgccccccacctgcgctacgccgccaccaccgacgagggcggacgcggcctcttcctggtcgcgcagctcagcgagcactggggcacccgctacacgcccgagggcaaggtcatctgggcggagctggccctgcccggaggcgagagcggcacggaggccgccctcgcggccttcctggacgtggacgccctctgacccccggagagtcctccgaggaggtcaggcacccgcccgcagggccttcagcgccgtctccagcgcctgctccgccgggaccgggacgtcgggaacgacccccacgccctcccagttgccgcccgtgacggtgttgatcgtccgggccgccggcaccgtcacgaggacgtgctcggcgaccgcgtaccgggccgtcggatgggcgccgccccgggtggtcgccccgacgagaacggcccgcccctgcgcctggagggtgtacgccacgtcctcgcccccggagaaggtgaactcgctcgtgaggatgcggaccggccggtccaggtagcgcggggcgggcaggtgcgcgaccgtccagtactggcgggtcgtgtccgaggtccggtcgtagatgtcgttcaggtgcacctggtcgtcggggaggaagtagctgcaccacatcgcggcaccctccggggccccgccggagcagccgcgcaggtccagcacgagggcggagctgtgcgcgaccagctgcatggccgcgccgatcgcgctcgcgccctcgacggcgctcgcgatccgccggacctcgatgagcccgatgttgccctccagccgctcgacgcgctggatcccctggttctcggcccgcagcagcgccaggaacgcggcctccccgccgtcctcgtccaccgggtccagcgactgcggctcgtccgtccacagcagacgcaggtgcttgtccgggcagacctcctggagatcggccgtcaccgtctcgcagagcgccggcccgtccaggttctcgtacgcacccgccgccagacggccccgtatcgcggccccgacgacgagggccttgtcggggaagacgtagcccgcgccgatccggtccagagcgcgttcgatgatctcttcgttggtaggcatggggcctgatgctaggcgtcaacaccccggccgaccaagggtcttcgctcagccggcgctcgtgccgggcgcggtgcccggggcaccgccgggttcggtgagcatgtcgtcgacgatccgcatccgggtctccggcaggcgctccgcgatcgcctccaccatcatcgcgaccccctgcgggtcgggcgccgaacagcggtcccgcgcctcctcgtcgggccagcgcgcatacgccacccaggtgccgtcgtccgcccggtgcagccgggacccgtaactgccgcaccgcgtgtggatggcggccgtcacccggtgccagccgtcggtgaactgctgctccatgcccggccgcagccgccaccggtagatcacagcgaacacgcctggatacctcccccgtcaggatgtggatctttcctggccaccctagggggtgccttgcaggaccgggcgtgcgagaagaaacctcgcgaccagcgccgacgcgctcgttacgatcggccggtgcaccccgaaccccgcccctggaccccgtacccgaagatccccgccaacacccggctgggcgaggcccgcgggcggaactgggtcgcccacgagaagatccacggcgccaacttcgccgtggtgtgcgacgcttcgggcgcctaccccgccaagcggcgcgaactgctcgctgacggcgggctggacgacttcttcggcgtcggccggatctggcccgcgctggcggtcgccgcgatccgttgcgcccggaccctgcgccaggacaccggagcacccgcctccgcggtcgtcaccgtctacggcgaactcgccggcggccgctacccgcaccccggcgtacccgccacgcccggagccgatcccgtgcagaccggagtctggtacgcccccggactcctctggctccccttcgacgccaccgtcaccgacgacggcggcacgcgctggatcggggaccggacgctgcgcgccgcggccgccgaggccgggctgctctgcgtcccgctgctcgccgaaggcccgctcgcacgcctccaggagctgccggtggtcttccccacccggctgcccggcctgctgggcctgcccgcgctgcccgacaacctcgccgagggcatcgtcgtcaaacccgccgacggctcccgcggacccgggcgccccatggcgaaggtgaaacagcccgccttcgccgaggacgagcggtacgacggctcccgcccctaccaggcgccgcccgacggcgtggcgggagtccccggctggctcctcgcccacggcaccggcctgctcaccccggcccgggccgcgtcggccgtgagcaagctcggcccctgtaccccgccgggagacctggccgccgagatcgcccgcgacgccaccgaggaggtggcgcgggaactgggcggcctggacgggacggcgtaccgggccctggaggaagccctgcgcaccggagccctggccctggcccgcttcgacgccgccgaccgccgcgcctgacagcaccgggcgcggggtcggccctccggctcacgccgggttccgccggtgacgacgccactgtgcatactgctgccatgaagtccccgctcggcgcacgcgtccacctgatgatctccttcgtcctggtgacctgcggcgcggtcgccggagcctgcctcgggctgctcctgtccggccggctgacggcgctggtcttcgcggccgtggccgggctcggcgcgggactgggatcgttcttctcccgcaggcaggtcctcgccctgttcgagcccgaccgcgaggacgtcccggccgacggctacgccgagggcctcgccgacgccgcgctcgtctgcatcgcgacctaccaggcggccgtcttcccgctcacccccgacggggtgagcgaggccgagcgggaggcccgccgcacgatggcctaccggatctccgcctacgagggcctgccgtacccggtgcagacctcggccgccgccgccctcgaagccatcgaccacggcgcggaccccaagcgggcggagagcgcgatgaaggcgctctgcctcagcatctacgacaaccgccgcggccggtgacccggcgcgcaccggagccgtccggtgcgctcacctcattgtcctatcggctggtcggcaacggttgggcctcggtccggcctccggcagtggcctgatgcggatcatggcgttgtccggttatggaatctgacgggatgctgttcgctcgggcgccgctcgacggtgtcgtctggctcgacacactggtccacgatccggcctgcgggtcctgcccgcgccggcgggagccggaagaggaatccgaggaggcggaccccgacgggatcccggtgctctcgggccgggcccggaactggatggtggccgcgtccgcggtcacggtcgtctcggccgtactgaccgtcgtggccagctgacggcctccccggccggctcgccgtacccgcgccggcgcggactcatccgcccggacggagggtcaccgtccaggtttggtaggtgtgcctggcgggccggtcggggtcctgttcggtgatggtcacggtgatctcgtcgtcgccggtgcggtgcagcgcgccgtggtgacgccaggtctcaccggggtccacggccagcagctcggcgaggaccgtgtcctccagccggcggctgacggcgcgcagcactccggcgtcgagaacgagcagggtgccgtccggcagcacgagcggcgccgggacctgcgggtcggtgagcgacggtccgcgttcgacggcgccgccgggcaacagccggaccacgcggctgccggtggggatgttgcggtcggtctccaccacccggatgccggttccgacgacgtagtgcccgtagctgcgccaggagtcgtacagggtgccctcgcggtcgtacgcccaggtgtcgaaggcgtcgtagccctccaggcccaggacgaaccgccctcctcccagggccgcgccgcgcgcgccgcgcagttcggcgatccggctgccgtccgccaggtcgagcagcagggccggaccgaggttgccccagggcgtgtaggcgagggagtccgtggtgaccaggacccgaccgcccgagacgtgggcggcgttggggatgccggaacagagcgcggtccaccgggtacggcccgagtcgtcgacgcagctgatcttcccggcggtgccgtggatgcgcaggtcctgccgccgggcgagcggcctgcccccgggccggggcgggccgcccggcggcagaccggtcccgcgccgccccgcccgcaccgtcacgtgccatgctccggcacggccgttcccctccgatgtccccatggacccagatgctagggggtgtcttgggcgcgcccggtccccgttcgagaccgtggtcgatccgacgacacaccgtcaccaagctgtgaagcttctgcgggacgctggtgctcaccagctcggcccagcccggcgcgttccgcgctttccccagggggaccaccatcatgaacactgcacgcaaggctgtcatcgccctcgccgccgtatccgcaatggccctgacggcctgtgggcccaccgaggacggcgcggcgggcggctccgggacgccgagcgcgagcccgaccgcgagcgcgaccgccggccccggggcgagcgcgaccgccggcccgggcgcgaccccgtcgaagtccgcggcgccgaagaagaccgcgagcccctcgaagccgccgaagccgggcgcgaccgaccccgactacgacgtcttcccgtgcagcacgctcgacgtgacgttcacggcgaacctggccgagcccacgaccagcagctacctgctgaagatcaccaacaagggcaccaaggcgtgcagggcgctcgggcacccgatcgtcaccttcggcgacctggacggccaggccacggaacggggcgcggcccccggcatcgaggacgcgctccggctggaaccgggccagacggcctacgccgggctcatgggcggcgccaacgacggcaagggcaagtccgtgaactcgatcgcgctgaccatgaacaccgagtccgacctgaagcagacaccgctgaaggcgtcgacccccggcctgtacgtctcgccctcgaagaactccgtgaccgcctggatggacaacgcggaggacgcgctcagcctgtagacgggaccgcgggcccgcggtgacggtcccggcacgtccgggttcatccggtcggccgagcaacggaggacggccgcgcccggccgggtcaggctgtggacaaggaccgtcaccaccgcacagacgaggaccgagcccatgtcccacagccgacgtatcagcaccatcgtgggcgtcgcagcactgctgctgacggccagcgcctgctcgggtctgggccggagcaccgtcggcatgctgaccttccgcggccacgactcaccggtcgagctcagctactccaacacgctggtcgtcggctgccacaagatcggcatcccgaagggggccacgcacgtcgagaacaacaccctcgtcgacatcgtcctgtaccggacgccggactgccagaagaccgacaaggccgacgggatctacgtggcgaccaccctctcgaacgtcacggcccccgtgagcctgccctggcgcagcttcagcgtcatccactgaccccgcgcccgcccgcccgccggcccgccgcttgcgagcgggcggggtctgtcccatagtccgaggtatggacgagcgcgaggcggcgctcagacaggcgcacggtcatgccgtccgctggctggccagcctgtccgaccgcccggttcccgcccgcgccacggtcgacgagatcgtgcgcgcgctcggcgccgagctgcccgacgcgccgagcacgcccgccgacgtggtcgacctgctggccacggcctgcgagccggggctcaccgccttccccagcggccgcttctacggtttcgtcgtcggcggtaccgagccggccgcgctcgccgccgactggctggtcagcgcctgggaccagaacagcgtgatgcgcgccgtctcacccgcgtacgcggcggccgaggagatcgccggcgcctggctgctcgacctgctcggcctcccgcccgagagctccgtcggcttcaccaccggcgccaccatggcgaacttcacctgcctcgccgccgggcgcgacgcggtgctgcgccgcaacggctggaacgtcgcccacgaaggactcgccggcgggccgcccgtacgcgtcatcgcgggccaggaccgccacatggccatcgacctcgccctgcgctacctcgggctcggccggcccgaactcgtcgcggcggacgatcagggacgcatggaccccgaggccctgagccgcaccctggcggccgcccaccccggttcccgccccggtcccgaacccggccccacgatcgtgatcctccaggccggcgacatccactccggcgccttcgaccccttcgccgagacgatccgggccgcacgggaggccgacgcgtgggtgcacgtggacggagccttcggactctgggcggcggcgtccccggcccacgcacacctcgccgagggctgcgcccaggcggactcctgggccacggacgcccacaagaccctgaacgtcccctacgactgcggcctggccgtcgtccgcgactcctccgcactgcggtcggcgatggggctgcgcggcgactacctcatccagcacgaacacggtgaccccgtcgacaaggtccccgaactctcccgccgcggacgcgccttcaccgtatgggccgcgctcagatccctcgggcgccagggcgtggccgacctcgtggaccggctgtgccaccacgcccgcaccttcgccaccggcatccgtgccatcgacggcgccaccgtcctcaacgacgtggtcttcacccaggtctgcgccgacttcggcggcgacgaccgcaccgaccgggtgctcgcccgcctcctcgacgagggaacggcatggatcagcggctccacctggcacggccgccgtgtcatgcgcatctcggtgagcaactggtcgacgaccgacgaggacgtgtcacgcaccctggacgcgatccgccgcgcggcctcgaaggctttccggccgtgaggggccgggccgcgcccccacccctcagcgggtgagcgtgacgggcgtcgggccgtcggggcggacggtgatgctgtacgccgccccggtgggcacggcccggaagtacgggacgtgggcgggcagcaggagttcgaggagggcgaccgactcccgcagggcgaactgctggccgaggcaggcgcgcgggccgatcccgaacgggaggtaggcgcccggccgggtgggacggccgccgggaaccgtgaagcgccgggggttgaagtgctcgggatccggccacagttcggggtcacggtgggtgaggtaggggcagaccagcaggtccgtgcccgcctcgacccggtagcccgcgagaacctcgtcctcggtggcgtgccgcggcaggatccaggcggacggatacagcctgagcgtctcgctgaccagtgcctggacggcttcgcgccgctccggtgagccctccgggccggccgagagggccgcctcgcgtgccgcggggtggcggtcgagaagcaggtacagccaggtcagtgtgctcgcggtggtctcgtgcccggcgacgagcagggtgacgagttcgtcccgcaccagccggtcggtgtactcggggtgctcggcggaggcgtcgaccagcacctggagcagccccggtccgtcgggtccgggggcgccctcccgggccgcggccaccgcccgccgggcgacctcgtcgatcctggccaggtcgtcggcgacggcgtcccgggcgtccacccggtcggccggcagggtcggcagcgcggccaccacggcggccacggcggtcagttcgtgcgccgtggtgtcgtcgagcgggtgcccggtgagcgcccgccagatggtgtccagggcgaagcggcgcatctcctcacccaggtcgaaggtccgcccggtgcacgcgtggccggcccaccgggcggccgtggtccgggcggccccggcgatccgctcctcgtagcggcgcatccccttcccggtgaactgcgactgaagcagcttgcgttggcgcttccaggcctcaccggtcgcggcgagcaccccgtcgccgatgagcagccgggcgcggtgggagcgcttgacgtaccggtcggggtgcagggcgagtacgtgctgcacggcctccggcccggtgaccaggacggtggggctcggcccgagacggaacgcggcgacaccgccgagccgttcccttacctgggccagcaggtcgaccagttcaccctggtgggcgcgccaccgttccacgcagccggcgtcggcctcggggagcggtcgccccgtccctgaccgctgcggggcggacggctcgctgctcgcgtcgatggccacggctcttctcctgtccggctgtcgggcccgggcccgggggtgcgtcggcatcacggactgtacggggacgggcgggtgcggtgacagcgccggagggccgatggcccgattcagacgggcggctggtgggcgggcccgccgatgcgggccgcgaggagggcgatgtcgtcgtcggcggaggcggggaccagatgggcgatgagcgagtcgcagaggtggtcgagcgactgctggggcgtggcgagcagaccggtcagctcgcccagacgttcgtcgatgtcacggcggcgcgcctcgatgagcccgtcggtgtacaggacgagggtgctgccgggcggaagggcgatgtccgtggtggtgaaggagatgccgccgacgcccagcgggacgcccggcggggtcttgacgaggtagacggtaccgtcgggctggaccacggccgggggcgggtgtccggcgcgcgtgaccgtgcagtggccggtggcggggtcgcagaccacgtacaggaaggtcgcgagcatcgggtcggacaggtccgcgagggtggcttcgagctggtgcagcagggcggtgggaggcatgtcgaggcggccgagggcgcggaccgtcgcggagaggcgtcccatcacggcggcggccgcgatgccgtggcccatgacgtcgccgatgaggagcgcggcccggcctccgctgagggggagcacgtcgtaccagtccccgcccacctcgttgacatcgctggccggcaggtagcggtgggcgatctcgataccgggcggcggggtgatgtgctgggggagcatgctgcgctggaggacgaccgcggtctcgtgctcgtggtggtagaggcgcgcgttgtcgatgctgatggcggcacgggccgccagctcagtggcaagggtgacgtcgtcggacccgaaggggccggtgtgcccggtgcggtagaaggtggcgacgccgaggaccatgtcgcgggcgatcagcggggtcatcatgaacgagtgcactcccagctccaggagctgggccggtttgggggagtgccgggccgcgggggcgacggaccgttcgtcgaggtgggcgatcaggaacgactggcgggccgcgagggcctgggtgtagggcgcggtcgtggggaagatgagggtccggcccaggggcgccagggactgggtgacggcggagccggtcagcggagccttgcccagacggcgcagggcgacgcccccggacaggcccgtgcccggctcgatgccgcgggccagggaatccaggacgtcgaccgtgacggcactcgcgaggtgcgggacggcgagatcggcgagttcctgcgccgtgcgttccaggtcgaggctggcgccgatacgggagctcgcctcgctgagcagggcgaggcggcggcggcccgcttcggcctcggtgtggtcacgctgctgcacggtgatgtcgaggagcgaggcgatcacgccgatcggccggccgccggggtcctcgacgcgtacgtacgagcacgaccacacgtggtcgtggtccgggtcggccggggtccgaccggtacggcgccggtcgaggacgggctcacccgtgtccaggacctcgcgcatcgcctcttccatctggtcggcgttcacctcgggcagcaactcggccagccgccgccccacatgggcggactcggcgaggccgttcatcgcttccagggccgggttgacctggaggaaccgcagttgcgtgtcgaggaccccgatcccgaccggcgagcgtgcgaacagcccgtcccagacggccgaggagccccggatacggcgggccgcgtgcgcgtcggcggcgaagaccagcacggccgaggccccgtggcggcggtccgggaccgggcaggcccagatctccagctccagcgggtgcccctggctgtgccaggcggtgaccgtgcccatgaccccgcgcccggtggcggccgtctcccacagggaccggcccaggctgcgatcggctcccgggtggaggaggtcggagatgtgccgccccagtacctcgggcggtgcgtagccgaggagctgctgtgcgccgtggttccagcgcacgatcatcccgtcgctgctggtggccacgagcgcgaccggcagggcgcccagccatcctccggcatcctgggcggcgctgctgatcaggtcgtcgagcggcatctcctcatgcatcctgcacccgctcctcgggggcggtcccggcctcgcgccgcggcggtcccaccccggcggtgtgtccccccggggtgggggctgccaccggctcggtgggtgccaccgtccgtccggcgcccaggccgcgccgcggtgcgctcctgcctccgctcacccggcgcggcccgcggttgtgcgtggtccgcatctctcatcgtcgcccggacggcggtacggcgctccccggccgcgcggcccccgccgccaccggggcttcggcgcagcggagccgctcggcggtgacgggggcgccgtcggccacgttgcggtcgaaggtgacggccttgacctggacgggccgggagccgacggcgacctcgacgaacccgtcgagctccgggtcgcttcgcaggcgggcgccgggcagcgcggccgcgacggtcgccgcgttctcctcctggcccggggcgtaccggacgaccggcgggcccgccggtcgcgcgggcggtgcggccgccgaggtgtcggtgacgacgaacccgttgccgcgcagggcggcggcgacgtcggcgtcgtccacgtgcacggtgaaccgggccgggtcggtcggggccgggttctccgcgacgggctggattcgggtgtcgcccgtgatcgggcggtccgcgccgagcgcgtcccacagtgcggccgagcgggcctcgtcccacaccagggtggagcccactccgggtacgcggtggtcgaagagccggatggggacggtcgcgaactccgtccggtccgagcggaggtggccgagggcccagccgatacgcaccaggtcgtccaggccggtccgtgcgtcggtgcgtacggtcttcagcagggtgcgcacggtccgcgccgtgctgatcgggccggccagtgcgccctccgcggtgagccgggccagcaggtcgttgaccacgcgctgctggcggcggacccggcccaggtcgccggggcggaggttgacgtgccgggcccggacgtagcgcagagcccggtttccgtcggcgagatggcggcccgcgccgatgtcgagcccggagttctcgtccttgagcggcgtgtcggtgcacacggtggcaccgccgaggttgttcaccgtccgctcgaagcccgtgaaatcggtctgcaggtagtggtcgatgcggaggccggtggccttctccacggtggccacggtgagcgggccaccgccgagcgcgaacgcactgttgatcttgcccttgcgtgccggggtgccgtcggtggtgcccgcgtactcgacgtacgagtcgcgggggatggagacgatgctcgcgcgctgccggttccgggacaggtggacgagcatcatcacgtcggtgcagttgcaccccttgccgcccacgtggagccgccgcttctcggcggcggagagcccggcgcggctgtcgatgccgacgaccaggatgttggtaccccggccgccgccgcccgccgacgcgctcgcggccgagacggcctgcgagcccacgaaggaaccgcaggagagggcggtcagcagggtcacagcgacagcgatacgacgcaaggcacatccccagacttgtacgaaccggctgaaatcgggaatgtactggtccgctgtgcgggcggccggtctgtacgcgccgggattcctccccgcagggggcgggtttggtacatctgcccgccctggggagcgagcccgccccgtcagcgctcggacagctccgaaggcgcctcctggacgatccagccattgccgtcggggtcgtcgaaggtgatgaaggagttccaggttccgcccttgccctcctgccagcccgacgcgccgaggttccggacgggcgacacgtccacgccccgggccaccagttcctcgcgggccgcctcgatgtccgtgacgcacagctggaggccgtgcagggtgccgggtgccatgacccggccgtccggtgccgtgggcatcccctggagcatggcgatggagcaccgggaaccgggcggcgtcatctggatgatgcgcaccccgggcgagacctcgtcgtcgaggtcgacgccgaagcccaccttgtcggcgtagaaactcttcgcgcgatccatgtcggtgacagggacggggacgacttcgagcgtccagttcacaggtgtctccctcggggcatcagcgggtcgcacagcggggcgggtccaccgttgcccatggaggtccggtggcgcacgtcgaaacgcccggcgggcgccgacttccacgggaagggcgggccggcgggcgggtcactcgtcggggaggacgcggccgtcctcgtccagcgtgaggtggatgcgtgcggggtcctggctgttgacgtcggacggccgcggaccctccggcccgtcgagcccccagcgcagcaggcggcgggtgcggacgatctggtacagcacgtcctggaactccagccggttgacccggccggtccggagcgtgtccgcggcaccggcgtacgccgcgagcttcgcggcccgcaggtcggcggacctcccgccgtccgcggccgcccacgtacgggcgtccgtgcgcgggtcggcgtcctgcgggatgtgaccgcgcatccgcggccacatccaggtcagcgcgaagtccagcgacttgcgggcggcgtgcggggtcgcgtgcgggccgctgaccggccgccatccgtcggcggtccgctccacgaccgagaaggtcggcggcatcaccagcacgtcggggtgggtgtccagggcccgccgggagtcggcccgcacctcctcggggaaccggtcgcccgtgtagcacaggccgcgcagcgccagctgctcgaacgcctgtgtaggggtgaccggagcgtccggatccacgaccagctcctcatcgatcccgggctccccgacggcccggtcccagtcgggcacgaggggctccgggtcggtcgggcgcggcgcctccatcccgcccgggcccgacaccgcgtactcctcggcgcgcaccacccggtaccgggtcccgcacacgacgaggtcgtcgacccgctcgctctccagccgggcgaccgccgccaggagcgcgcgccgctccgcccggtccttcgcctcgtccttcgcgtggaaccacagccgcgagttcagcgcgtcgcgcgcctgctgcgggcagccggccgtcacttcgagcaccacccgccagcgcggcccgtcctcgggggactgcgccgccaccccgaacagcggtccgcgcaccaccacatcgcccgcacgcgccgcggcgtcgagcgcatcggcttccactgcggcttccaccggttccaccggcacccgcaccaccaccggccgcgacccgcgcggcctcaagtccccacggtccatgcggccatcctgccgaccgttccgcgccgccgtccccgattcaccgattccccagccccgggagacccgcgcgcggtaccgtccgcgcacccctgacatttgtcactgcccaccccgcgggacgcgcgcgagccttgacaggggaagcagcgcggcgacgacgggcagggggcggccgtgacggtgacggaaccgacggcagggaccgtgacgccccggcccacccgggccgggatcctgcggatatgggcggcgtcgctgacggcggtcgtgctgcggcgtccgccggtaccggggcccggaccgggacactcggccggtacacggcaggtggtgctggttctggcggtgacggagatcgtggcggccttcctgctctcctcgatgctgccgcccgcggtccggccggtgcacgcggccctggaactcctgctcgtgctgggcgggctgggcctggtggccgccctggtccggcacccgcaccaggtggacgagacacggctggtcctgcggaccgccttcctcggggacctgaccctgccgcgctcggcggtccgctccacctccccggtggtacgcaccgtcgccggccggggcccgaggccggtgcccggcgaaccgggcgcggtggcctgctcggtggagagcgccctgaacgtggccgtgcacctggacccgcccgtactcctcgacctgggcccgcacggaccggtggcggcggtgaccgtgtacgtctcggtggactcgccgaccgccctcgcccaggccctccgacgcgtggacccgccccacaagcggtaggccgtcccggcgccgtccgagcccgatccgccgggcacccctatcctggacaggtggagtccgcccaccgcgagggagggaggtcccgtggtgaccgcgagactacgggtgacgacactggacgccgggcccttcaccatgccgaagagcgacctcgtgtacggcgcgaccggcatggtcaccgtcccctccacggtcgccgtcatcgagcacgccacgcacggaccggtcctcttcgacacgggggtcaaccaccgcgtggcggaccccgagcaggccgaggcccactggggtccgggcctgcgggcggcctacggcgccgaggggttcacccgggcgcacgccgtcgacgcccagctggagcgcctcgggtaccggctcaccgacgtcaggtacgtcctctactcccacctgcacctcgaccacgcgggagggatgacctacttcccgcacgccgtgcatgtggcccagcgcgacgaactgcgccatgcctggtggccggaccgctggacggcccggggctacgccttcgacgactacgcgggcagccggaactacgacttcctcgaactgggcggtgacatcgacctgttccaggacggcacgctcaggctcgtgcgcaccgctggccacacacccggccaccagggcctcgtcctggacctcgaccaccacggacggatcgccctcatgggcgacgccgcgcacctccagcaggggctggaccacaacgtgcccatgctcagcgactggaacaccgaggagaagatgctgacccacgggcgcctgcgcgcgctgtcccgggccggcatccgggtcttcctctcccacgatccggaccacttcgccgcactcccgcacgacggcgagttctgggactgaggtcccggcgagccgccgccggggccgcgcgccaccccaccgggcgctgtcccccgagggggtccggtggggcgggatcgtgcagcgaggcagcccgcctcaacccgtgaacgggaatgccccgactgtagggcgcaccactgacaacggccggaagaccggaactgaattcgtactgatgtgcgacacgggagcggtccggcgggctcggaatgccggaccggcccgcccggagcaccctggggatatgcgggacccggcgatgccgtcccgcccccggtgccgccctccggcggccccgacgcctggggaggcaggaccgatggccaactccgaccgaccgaagggctgggggccgctccccgatccccctccggaactgttctacgcgcccccgggcgagccgctcgacgacgcacggcggaccgcggtcctcgactggacggtgaaccagtacgtcgccctcggatggcgcgtcgaatcgcgctctccgacccaggcggtgctggtgcgcggcgggaacgtcaaccacctcctgcacgcgatcctgaccatcttcacctgcctcctgtggggcgtcgtgtggatcgtgctggcgctgggcaacaggacggagcgggtcgccctcaccgtcgacccggtcggccgcgtacagaccgtgcacggtcccggctgaagcggccggccgaccggccggaggaccggctgaccggccggacccgtcagacgtccgggaactccggggcgatgcccagcgcgggtgcgatggcccgccagatcgtcgaccgggccgccgcgaggtccacccgggggtcgtcgagcatcagccggatgccgaggccgtcgcacagggccagtacgagggtgccgagcgcggcgacgtcgcagtcggtgaactccccggagcggatgccccgttccacggccccgccgacccacgcgtgcagttggtcgtacaggtcgacggccaagtgccgggccgccgtgtcgcgctgggcccgcacccacaactcctgccagagcttccagtcctggcgcagttccgcgtccgtcgggagcatgctgcgcaggatgcgggccaggacgacggaggagggcaccgagtcggggactccctcggtgtccgtaccggtctgcgcgaaggaatgcgtcatcgcctcggcgaagagcttctcgcgcgtgtcgaagtggtagtgcagcagggccttcgacaccccggcgtgctcggcgaccttgcgcatgctgacgttctcgaagccgatgtcggcgatcacctcgcaggcggccgtgaggattcgctcacgcgtctcgattgcgcgctcggccttggtcacgtcggctgctccccgtgtcggcgcccgtggaccgggcgggtgggcccggttgccgtggccaccacggcaccatcctcgcgcatcgcgccgcccccgcggtcgccgtaggtgtggaagcccctgcccgtcttgcggcccagccggcccgcgtcgaccatccgggccagcagcggcggcgtggcgtacagcggttccttgtattccgcgtacatcgaccgcgcgatggcctgcaccgtgtccaggccgatcagatcggccagggcgagcggtcccagcgggtgcgcgcatcccagggtcatgccccggtcgatgtcctcggccgacgcggtgccgtactcggccatgcgcacggcggccagcaggtacggcacgaggagcgcgttcacgacgaaccccgcccggtcccgggcgcggacgacctccttgcccagcacctcggaggcgaacgcgtgcgcccgccggacggtctcctcggcggtgagcagggacggcaccagctcgaccagcgcgagcaccggtacggggttgaagaagtgcaggccgacgacctgctccggccgtgagacggccgtggccagcctgatgacggggatggaggacgtgttcgtcgcgaggacggcgtcccggcgctccaccacccggtcgagcagggcgaagacctccagtttcacccgctcgtcctccgccaccgcctccacgaccaggtcccggtcggccagccgcgccacgtcggcggtcaccgcgatccggccgacggcggcgtcccgttcggcggccgtcagcttcccggacgccgcagcgcgttccagggagcggacgatccgctccaggccggccgcggcggccgtacggttcgtctccaccaccacgacgtcgcgtccggcccgggcgcagacctcggcgataccggatcccatcagtccgcagcccacgatcccgacccgttcgacatcggtcatcgaccggtcctccctcctgtgatgcctgatgatgcttgatgcttccgacgcccccggggcccgtgccgctcccgctgtccacggggccgtgggcgtgggcgggagcgggagcgggagcggccggcggtccgggcggcccggtgggcgccgtccggaccaccggcccggcccccccgtcactcggcggacggcatccgcagaacacccgtaccgcgcttgaccagttcgcccgcgatgatcaggcgctggatctcggaggtgccctcccagatccggtcgacgcgcagctcacggtagaggcgctcgaccgggtaggagcggtcgtagccgcgcccgccgaagatctgcaggcaccggtcgatcacccgccccgacgcctcgctcgccgccagcttcgcgatggccgccttcgcgtgcagcgtcttgcggtcgaggacgccctcgtcgacctcccaggccacctggtgcgtgtaggcccggttgacggcgatgtccacggcgctgtcggcgagcatgccctggatcagctggaagtcggcgatgcgcgagccgaactggcgccgctccaccgcccagtcccgggcgagttccagggcccgctccgccgccccgatcgtccgggcggcgatcatcagccgttcctcggtgaaccaggagcgcgtgatgtcgtagccctggcccacctcgccgaggaccgcgtcgtcggggacgaacacctcggtgaaggtgaactcggggtgctcgtagacgaaggtgtgcatccagcgcggcacccgggtcatctcgatgcccgtcgtgtccttgtcgaccaggaagagggtcggtgcgcgctcctccccggcggcggccagcacgatcatgaagtcggcgtggtcgccgacggtcacgaaccacttctcgccgttgaggacccagccgccgtcggtccgcgtcgccgtggtccgcaggttctgcgggtcggaccccgcctcgggctcggtcaccgcgtagcagtcccggcgctgcccgcggatcacggggacgaggtagcgctcgcgctgctcgggcgtgcagaaggacagggcgttggccggacgccacaccatgtcccacagggccccggtgagccggccgagctccgcctggaccgtgacctgctccaggatggtcaggcccgcgccgccccactccttcggcatgttgacggcctgcagcccgctgtccaggacggcgtcgcggatctcgatgtgggcccgcgggggcagcccgttgttctcctcgcagtcgagctcgtacttcatgatgaagtcggtgagcgagcgcgccgcgccccggagctcttcctggcgggcggtgaggcggaagtccatgttctgtctgtcctctgggtcgtggtgggggagcggtcgtcaggaagcggaggagggggcgggggcgcaggcggggagggcgagggcccgggtgccgcgcttgatcagttcgttggcgatgatcaggcgctggatctcggaggtgccctcccagatccggtcgacgcgcagttcgcggtacatgcgctcgacggggtacgtacggtcgtagccgcgcccgccgaagatctgcacgcaccggtcgatgacccgccccgcggcctcgctcgccgcgagcttcgccgtcgaggccttcgcgtgcagcgtcttgcggtcggtctccggccggtccgcctcccaggccacctggtgggtgtaggcccggttgacggcgatgtcgacggcgcagtcggcgagcatgccctggatcagctggaagtcggcgatgggggagccgaactggcggcgctccaccgcccagtcccgggcgagttccagggcccgttcggcggcgccgacggtccgggcggcgatcatcagccgctcgtcggtgaaccactccttggtcagctcgtagccgttgccgacacccccgagcacgtccgcgtcggggacgaagacctcggtgaacgtgaactcggggtggccgttcaccgcggagtgcatgaagcgggggacccgtgtcatctcgaccccgggcgcctgcttgtccacgaagaacagcgtcgcggcgcgctccggccccgcgtcggcctgcaccagcaggaagtccgcgatgtcgccgcaggtcacgaaccacttctcgccgttcagcagccagccgccgtcggttcgggtcgcggtgctcgtgcccgagcccgggtcggagcccgcaccgggctcggtcaccgcgaacgcgtcgaaccgctcgccgcggatcaccggcagcaggtacttctcgcgctgcgccccggtcccgtgggcgaggacgttcgcgggccgccaggggatgtcccacaggcagttggtgaccttgccgaactcctcctcgacgatgacctggtccagcagggacaggccggcgccgccccatgcggcgggcatgttgatggcgtagacgcccgcgtccatggcggtgcgggtcagttcacggacggtctcgacgggcagcgggccgcccgcctcctccgaccggtcctcgtaccgcatcagcagccgggcgtaggaggcggcgcgggccttgagatcggcctgttcgggcgtgtagcggaagtccatggggggtcagtcctccagagcacaggtggtggggtggagcggtcggcgaaggacggcccgcgcgtccagggccagggcgccgtccgggcgcaccagcagggggttgacctccagttcggcgatctccggatgcgccgcggcgacggtggtgatccgttcgatgacggccgcggccgcggccacgtcgacggccggccggccgcgtacgccgtccagcagcgcggagctgcgcagaccgcgcagcagggcctcggcccgcgcggccggtacgggcgcgagcgcgaaggcgacgtcgcggagcgtctcggtgaggacgccgccgaggccgaccagggcgaccggcccgaaccgcggatcctggttcacgcccacgatcagctcgatgccgtccgtgagatcggccatcgcctcgaccgagtagacgggtgcgcccaggcgggcgtgcatctcccggtacgccgcgaggagcgcgtcccggtcggcgaggcgcagcgccaccccgccggcgtcggacttgtgcaggacgtgcagggccttgaggacgtacggaccctcgaactccgcggccgcggcgagcagtcctgcctcgtccgtgatctcgcgcgccgccgggaacggcaccccggcggcgccgagcagcgcccgcaccccgtggtagcccggatccgccagcggcgtggcggcggacggcagcgggggcacgccggcgctgcggtccgccgcctcccgtccggtcatcgccgccagcgcgcgggcggcgtcctcggtggcggcgaacaccggcaccccggcctcggccagcgtccggcagctcggcgaccgcgggtacatcgactgcacgaccagcggcttcggcgccgacacgaggtgggagacgatctccttggccgcccgggcctcgccctccgcgaggacggaaccgcccgccgggctgccgccgagtccgccctcggaggcggcgtaaccaccgaagtacccggtcatcaacacggcgtcgacctcgtcggaggccagcagtgccccgaccgtgtccgcgtaggacaggggccgctgttcacccattcccgccaggtccacggggttgccgaccgacgactgctcccacagcacggtcagcagcgcgtcctgcgtcggcccgccgagttccggtacgtcgagcccggcgtcctcggccgcgtcggcggcgaccgcgccgtggccgccgccgtcggtgaagaccgcggtccgcctgccccgcgtacgcaccccggcgcccagtgccgccaggacgacggtcatctccctcggcgtgcgcacgagttcgacccccgcgtcgcggcaggcggcggccaccacgtcggccgaggtggtcagggccccggtgtgcgactgggcgctgcgggcggaggcggtgccccggccggccgtgagcagcaccaccggcttgcccgccgcggcggcggccgccgcgaaggcccggccgtcgccgaagtcctcggcgtacacggcgatggccgaggtggcctcgtggcgggcgcagtcccggacgaggtcgacgagggtgacgtcggcctggttgccgagggagacgaagcgggagtagccgaggccgtgcggctcgccgcggagctggagttcgagggcgaggttgccgctctggctgagcagggcgacaccgccgggggcgaagcggtccgaggcgaggtacagctcggtggtgttgtcggcgatgcccaggcagttggggcccacgaggacggctccggcggcccgcacccggtcggcgaccgcccgctgccgggccaggcccgcggggccggcctcggcgaagcccgcggtgatggcgacgatcgccttggccccgcaggccagggcctcgtcgacggcggcctcgaagccggcgccgggtacggagaccaccaccaggtcgacgggttctccgacggcggacagggaggtggccgcggtgcggccgagtacggtgccgccgcgccggttgaccaggtggacgggccgccggtcgggggcgcgcagggcctgggcggccaccgcgtggccgtacttcgccgggtcgtcgctggcgccgacgacggcgaccgagcgggggtcgaagagggcggtcaggtcgcgtcccatgtcagccctccacgcgcagggcggagttggggcagctttcgacgcaggcgcgggcggcgtcctcggtgccgggcgggacgacgacggcgatgatgttcgcgtagccccattcgtcgagttcgaccaggtcgggtgccggttcctggcacagtccgtagccctggcagcgggtggagtcgagcaggagtttcatggcgttcctttcagcgcgggcacgggggcggcggtgggcggggaggagacctccggcacggccacggtgaggcggcgccggccgtgcgcgggcacggcgtccgcgcaggccgggcacggcgcggcgagatgggagcggacccgttcggggaaggagcgcagcaggctgcccgcgatccccgcggcggcgtcgaggagtccgcaggcgccgcgcccggtcaggccccgcgaccagcggagcaggctgtcctcggtgtccgggccggcggtgccggcggcgaggccgtacagggccttgccgacggccgcggtgccggacacgcagaccccgcactgccgggcgctctcggccgcgagatgcgcggccgcatcggcggcggtggtcacggggcagctgccgggggcgaggaagcggatggccccgcaccccagggcggtgccggcggcggtgagcgcgccggggtcgagggggagatccagggcaggggcgtcgacgaggccgccgaacagcccgcccatcagcgcgccggccgggtcggggttcccgtaccgcgccgcgagggtgcgcagcgtgatgccgtacgggacctcggtgagcacgggcgcggccgggccgccggacagcgtcaccagagtgtggcgggcgatggcgcgccgcaggtcggggtgggtggcggtgagcgcgatccgggcgagcgtctcgacgttggacaccagggtcggcgcgccgcccacgccccgctcgaacgggcggggcggcttggcggtgggcagcgccgggccgccgtcgatccggcggacgaccgccgtctcctcaccggcgacgtaggtgtggccggtctcgacgaccgcgacgggcaggggcggcgggtgctcggcgagggcccggcgcacgctctcggccgcgaccgggtccgagaggtagacgaagccgcgcacggctccggtgacggcggcggcacgggcgaggccgtcgaggaccaggtgcggccgggcccgcagcagccagcggtccttggccgagcccggttcgccctcctcgccgttggccacgacgacgggggagccgccggagtggcgcacggagcgcagtttgacggcggccgggaaggcggccccgccgcggccgcgcagcccggaggcgtcgagatgggcgagcaggtcctgcgggccggtggcgtcaccgtagccgcccgcggcgcggtaggcgtcggcgctttcggcgaggtgcggggccgccccgaggacgctgcctggcggccgcgccgtcgggagtcggatcgtggtcatcggccgactcctgtcgtggtgtgggtgcgcagggtccgtacggcgctctccagcgcggtgcggtcccgggcggtgcggccgtatcccggtccggggaggccgatgagcatgtggtggtggtcgaggacgacctcgccggcgagcagggcggcggccgggtcgcccgtccgggacccggcggccacgccggtcaccaggtcggtgacctcggcgaggtagcggagccagctgtgccggctgccgcgcaggatcaggcgttccacgcggcgccgctcggcggccgccagggcctgcggtggcggacccgggggcgcaccgcgggacgaggcgcgcagggcggcgaccgctgcggggagttctcgctccggttcgggggtgagcccgagccagtccagacgccgacgaccgctcatgcgtgcctccgggggacgggataccgccgccggccctgcgcccggcgggagccgggggcgcggcgggggatcggaggggatcgggggtgcgggcccggaccggccgggcgggccgcacggctgcgtccgccgcctccgccctggtgagcagtgcgaatgcggagcagggccggtgcggcgacaggaaagcacgtttgctgaccgatcggtcaggcaagaatcacgctagctgaccgatcggtcagtgaacaagtcttgacccggtggaaatgagccagcaatctggctgtccaatcggtcagcctggttccggcttccccgccccgaccgcctgtccgccgacggaccgccttgcctccgctctgccttgtcccacccccgccccgcctcgtcttgcctcgccatcgaacgccgctaccgatcgccgcacgccggcacggaggagttaccgatgcattcaagagctcccgaatccccgacaggccgcaccggtcgatccgacgccgtggatcggtccgacgccgcccttcggtccgagcggaccgggccgccgggccccgccgcagcccccaaggccccggctcccgggccgctcacccccgagccccccgctcgcgggcccgaccgcgagcctgccgcccccgacgtgcccgggcccgccctccccgcccgctactacaccgaccccgagaccgccgccgcggagacccggcacgtcttcgcccggtcctggcagctcgtgtgccacgagtccgacctgccgaacccgggcgcgcggctcgcagccaccgtcgccgaccgcgaggtcctcgtggtccgcaccgaggacggcggcctcgccgcccacctcaacgtctgccgccaccgcgggacccgcctggtcaccgccccggaacccgacggcaaggcgatccgctgcccgtaccacggctggacgtaccgcctcgacgggagcctggtcggcgccccggaggcccgccagatcccctgcctcgacaaaccgaagctcggcctcttcccggcccgggtcgagtcgttcctcggcttcgtcttcgtcaacctcgaccccggcgccgaaccgctggccaagagctgcgcgggcctcgccgaggcggtcggccactacgccggagccgacctggtgcccatcggccgcgcccggatccacgacctggccgccgccgaggtgcagcaggccaactggaaggtggcggtcgacaactacctggagggctaccacgtccccgtcgcccaccccggtctgatgcggctgctcgactaccagggctacacctgcgagatcgaggagtcctacgcgctcttcgcctccccgctgcgcgacaagccgtcctcgaactgggccgagcgcctgtaccagcgcatcgccgcccccatgccgggcctcggcgaggccgaccgccggatctggcggtacgcggtcatctacccgaacaccctgatcgacttctaccccgaccacgtactggcctggaccgcgatccccacggccgtggaccgcgtggccgtccccggcgcgttctacacccgccgcggcaccagcctgcgcacccgcctcgcgcggcgcctgaacatccacatcggctggatcaccaacgacgaggacgccgaactggtcgcccgcgtgcagaaggggctctccacccccggcttcgagcccggaccgctgtcgcggcgcgagtcggcggtcggctggttcgccggccgcatccgagcggacctcgacaccccctagagggccgcgcccaggcccgaccccccccgtccgcgcccccacccgcaccaccgcacgtgcgcgacgcagcgccccgccacccccacgccgcgcccgccgcatgaccgagcccccacgtaccgctcgttcccgccgtccccctgcggcccctacggagaggaccccatgtcccccgaggcactccttccgaccagacgctcgttcctccgcgccggcaccgccgcggccctcgccctcaccgcctccggctgcggattcgccaccgccgacgacccggcggaccgggcgaccgcgcaagcacccatcgacgtcaaggtcgacggcgacctcgtctacttcaactgggcggacttcgtcgaccccaccgtcttcgaaggcttccagaaggagtacggcgtcaaggtcgtccagtcgaactacgactccatggagggcatggccgccaaactcaacgccggcaaccgctacgacatcatcttccccaccgcgaaatgggccgagcgcctcgccaccggcggcaggctgcgtacgatcgaccactccaagctgcggggcgccgaggccgtgttcggcggctacggctacttcgccgacccctggtacgaccgccgctccgcgcacaccgtcccgttcaccatgtacaagacgggcatcggctggcgccgggaccggctcggcgacctgaccggctcctgggaagacctgtggaacgagaaggccaggggcaaggtcttcgtcctcgacgaccgtgacgaggtgctcggcctgggcgcgctcaagctcggcctggacctgaccaccggcgaccaaggcgacctcgcccgcgtcaccgacaccctgcgctcgctccgcccccgcctgcgcggcttctccagcgacagctacaacaacctcctcaacggcaacgccgacatgacccaggcgtggagcggcgacatggccgccatgctcgcccaggccgaggacccgtccgtattcggcttcgaggtcgcccgcgagggcgcccccgtcaactccgactgctacgcgatacccgccaacgcgcagcaccccggcaccgcgatgctcttcatcgactacatgctccgcccggagaacgtgaagaagaacatcgagtacatcggctacccgatgccggtccgtggcacggaggacacctacgccgcactcgtcgagccgttcccccagtgcctggtgaccgccgacgacctggcggccgacctcttcttccgcaacggcgacgcgggcaccgaacgggcccgcgacgccgcctggaccgacgtgaaggccggctgacatggcgacacgcagcgaccgcaccgggaccgcggtccggacgccccgggacccggccgcgccgaaggcaccacccggggaccggaccgggcccggagcccctccgcgcacccgcacccgcacccggacgaggcagccacgcctgtggacctggctcctgctccccggcaccctctggatgaccggcttcctcgtcgcctccctcctcctcgtggccaccctggcgctcggcaccaccgaccccctcggcaacccgcgcttcggactcaacttcgccaacctcaccgcactggccgaccccgcctacagcaccgtcctgctgcgctccctcggctacgcgctgatcacctgcctcatcagcctcgccatcgcctacccggtcgcctacgccatcgccctgcgcggcggccgcttcaagaacctgctgatcgccgcgatcgtcgtcccgttcttcgcgaactacctggtcaggatgtacggctggtccgtcgtcctctccgacgacggcccgctgctgcgggccctgcgcgcgatcggcctcgccgacgacagcaccaagatcctccagaccggcgtgggagtgatcgccggactcgtctacggcttcgtcgtcttcatgatcatcccgctgtacgcggcgatggagcgcatggacacctcgctcatcgaggccggccgcgacctctacggcggccccctgcgcaccttcctcttcgtcaccgtccccgccacccggcagggagcggccgccggctgcgtcctcgtcttcctgcccgccatgggcgacttcgtcagcgcccagctcatgggaggccccgaccagatcatgatcggcaacctgatccaggacaagttcttccaggggcagaactggcccctcggctcggccctcaccatgctgctgatggcggtcctgttcctcgggatgctcggctatctgcgacgcacccgcaaggacgaggcggaggccgcccgatgagcacacagccgcgtccgagcacgccgcgggccccgagcctgcagcaggccccgagcccgcaggaggccccgagcgggcggaaggacgggagcccccggcaggggccgcgcacgcagcggcgccgccggcgcggggccgagcgccgcccccgcttcgccatcgcggtcaccgccctcttcttcctgctcctctacctccccgtcggcgtcgtcgtcctgttctccttcaacgcccagaagtccctcaccgtcctcgacggcgtcagcatgcgctggtacacggccctcctccacgacgacgtactcctcgactcgctcggcatgagcctgcgggtgtccctcgtcgccatggccggctcgctcgtcctcggcgtggccctggccctgggcctcgtacgcagccgcagccgcctcggctccttcgccggcctgatcatgctcgtcccgctgatcaccccggagatcgtcacgggcgtcgcggcgatgctcctcttcaagggcctcggcatcaccctctccaccaccaccgtgatgctcgccgagatcaccttctccatctcctacgtgacggtcatcctccgctcccgcatcgccgccctgaacccggaggtcgaagaggccgccatggacctcggcgccacccgcgggcaggcactgcgcctggtgaccctccccgcgctgctgcccagcatcctcgcgtccgcggtgctgatcttcgccctcgtcttcgacgacttcgtcctcgcctacttcaccaccggcgtggacccgcaacccctgtccgtgcgcatctactcggcgatccggttcggcgtgcagcccaccatcaacgccgtcggcaccctgatgctggccggctccatcggcctcatcgtcctcgcactcgccatcccgcgcctgttcgggcgccgaggcggcctcgacctgctctccgggaagtgacacccatgcccacgacacccgagcacccgacccacccgacccggacccccgagacccggacccccatgaccccgacgcccatccacccgacccccgccgtccggctcgaccacgtcagcaagcagtaccccgccgcgggtgacgcctacgccgtacgcgacgtcgcactcgacatcgcggcaggcgagttcttctccctcctcggcccctccggctgcggcaagaccagcctcctgcgcatgatcggcgggttctccgaccccaccacgggcagcgtcctcctcgacggccaggatgtcaccggcctgccgcccaacaagcgcgacgtcaacaccgtcttccagagctacgccctcttcgaccacctctcgctcgccgacaacgtggccttcggcctcaagcgcaagggcgtcggccgcgccgagatccgcgaacgggtctccgacatgctcgacctcgtccagctcggccacctggcgggccgcaagccgcccaccctctccggtggccagaaacagcgcgtcgccctcgcccgcgccctcgtcaaccggccgcaagtcctgctcctcgacgaaccgctggccgcactcgacctcaaactgcgccgccgcatgcaggtcgagctcaagcagatccagcgcgaggtcggcatcaccttcgtcttcgtcacccacgaccaggacgaggcactgaccatgtcggaccgcctcgccgtcatgaacgagggccgcgtcgagcagtgcggaacgcccgaggacgtgtacgagcgccccacgagcagcttcaccgcctccttcatgggcacctccaacctcgtccccggcacctaccgctccggccgggtcgtcctcgacgacggccccgaactgcccgtcggcccgaggccgtccgtccccgagggcagcagggtcaatctgtcgatccgccccgagaagatctggctgtccgacctggagccggacatggcccgcgccgccggggtcgtccgcgagaccgtctactgcggcccgacgacgacctacctcatcgaactggcccccggcgtcacggtgtccgtgctggagcagaacaccgtccgctcgcgcatggaggaccgctggagcggcggcgagcgcgtcgagatcggatggaagcccgaacactgcctcgtcctggactgaagccgcgccccggtccgccacggctccgcccgacccgacccgacccgacccgccgcgacccggtcccgccccgacctcgcccgaccgaaggaacaccccatgaaccacgacgtcatcgtgctcggcgccggcctggccggtctcgccgcggcacgcgacctcgccgccggcggagccgacgtcctcgtcgtcgaggcccgggaccgggtcggcggacgcgtcgaacagaccgaactccccgacggccggctggtccagctcggcggagaggtcgtcggccgcgcccacaccgcctacctgaccctcgtcgcggaactcggcctcaccctggtccccagctacgtcgccgagcccggcgccctgacccgcgccacgcccgaaggggtcggggagggcgatccgccccactggttcggccccggcgacgacgcctgccaccagaaggtcaccgccgccttctgcgcactcgcccggtccgtcgacccgggagacccctggtcccaccccgacgccacggacctcgaccgttcctccgtcggggactggctgcgcgcccagggcgccaccccggccgtcgtccgcctctgggagatcggccaactcgccctcgccgacggttcgtacgagcgtacgtccctgctcgccgccctgcgcaagcacgccgccgtccccggccccgacgcctacgactacgaggcctgggagggcctgcgggtcgccgagggctccgccacggtcgccctgcgcatggccgccgccctcggcggatgcatccgtaccggagcgcccgtcgaagccgtcacggtccgccggcccggacactgctccgtacggctggccggcggcgagaccctcaccgccggcgccctcgtcagcgccctgcccgtcggcccgctccgccaggtcagcgtcaccggcgtgtccgacggaagactcgcctccctgcaccgccagcgccaggccctcgccgccaagttcgtcgccgcctacgaccggcccttctggcgcgacctcggtcgcaacggcctctccgaatgcgaaggggtcctcggcagcacctggccacagaacgagggcatcctctccgccctcgtaccgcccgagaggctcggcgtcctgctcggcgcacccgccccgctgcgcacccgcgaactcctcgccgacatcgcccgcctctacggcgacgaggcgtaccggccgctcgccacgtacgtccggacgtggggcaccgacccgtggacccaggggtacgtcacccagtggacccccggcgacgtcatggccgtcggccccctccacggcacccacgaaccacccttctacgtctgcggatcggaccagtgggtggccggctacatggaaggcgccgtacgcaccggacgcgacgccgccgaggaggcgctgcgccgtggctgaccccgtgctcaaccacctggcgggcgtggaccggcccgccgcctcgggcgagacgatggagctggtcgaccccgccaccggccgggtgcgcggtcacgccccgctctccggccgggccgacacggacgccgcctgcgcggccgccgctgccgcgtacgcccactggtccacgacgacaccggccgtacgccagcgcgccctgctcggcatcgccgacgccgtcgaggagcacgccgaggccttcgtggccgccgagaccggtgacaccggcaagccgccccgccagttcagggccgaggagctgcccgcgatcgtcgacaccctccgcttcttcgccggagccgcgcggaacctgcccggcctcgccgcggccgagtacaccgaaggccgcacctccgtactgcggcgcgaaccggtcggggtctgcgcccagatcaccccgtggaactacccgctgatgatggcggtgtggaagatcgccccggccgtcgccgccgggaacacggccgtgctcaagcccgcggacaccaccccctcgtccaccgcgctgctggcccgcgtcgcggccgagcacctgccgccgggcgtggtcaacgtggtctgcggcgaccgggacaccggccgcgcgctcaccgcccaccccgacgtcgcgctcgtcgcggtcaccggcagcgtgcgcgccggccgggagatcgccgccgccgcggccgccgacctcaaacgggtccacctggaactcggcggcaacgccccggtgctcgtccacgacgacgtggacgtgcaggcgaccgccgcggccctcgccgcggtcgcctactacaacgcgggccaggactgcaccgcgcccacccggctgctggtccaccaccgggtgcacgacgcgttcctcgcggccttcgcggccgaggcgggcaaactgcgcaccggcgccccggacgaggcggacgccgacttcggcccgctgaacaacgcggcccagctggcctcggtacggtccctgctcgaccggctgccccggcgcgccgagatcgtcaccggcggcgcacggctcccgcggcccggcttcttccacgagccgaccgtcgtggcgggcgtgagccaggacgacgagatcgtgcaggaggagatcttcggacccgtcgtgaccgtgcagtccttcgccgacgaggcggaggccctgtacctggccaacgacgtccgccacgggctcgcggccagcgtgtggacgacggaccacgaccgtgcgatgcgcgcgacccgggccctgcacaccgggatcgtctgggtgaacacccacggcaccaccgtctccgagatgccccacggcggggtcaagcactcgggctacggcagtgacctgtcgatggcgggcctcctggactacacgcaggtcaagcacgtcatgctgtgaccgcgtcgagcccctccgtgcccgcctggccctccgtgccctcggtgcccccggccccgtgcccgcaccctgacaagatcagccgttcagggaggccatcagttccggtgcgtagcggtcgcccgaggccacgccgtgcggcgccacggcgtcgatggcggccaggtccgcgggcgtgatcgtcacggcggtggcggcgacgttctcctccaggtaacggcgtcgcttcgtgcccgggatggggacggcgccctggtggagggtccaggcgagggcgagctgcgagggggtgacgcccttgtcggcggcgagccggcgcacctggtccacgacggccaggttgcggtcgaagttctcgccctggaagcgggggtcggtgcggcggaagtcgtcggcggcgaagtcgtccgggctggtgatggccccggagaggaagccgcggccgaggggggagtaggcgacgagaccgatgccgagttcacggagggtgtcgaggacgccgtcgtgttcgataccgcgttcgaagaggctgtactcggtctgtacggcggccagcgggtgcacggcgtgggcgcgggcgatcgtggtgggggagacctcgcacagtccgatgtggcggaccttgccggcctcgaccagctcggccagggcgcccatgctctcctcgatcggcacgttcgggtcgacgcggtgcaggtagtagaggtcgatgtggtccgtgcccaggtggcgcagggagcggtcggccgagcggcggatgtactcggggctcgcgttgtggccgacgaaggcgccttcgtcggtgaactcgacgccggtcttcgtggcgaccacggccgcttcgcgacggccggacagggcctttccgaggagctgctcgttgcggaaggggccgtagccctcggcggtgtcgaggagggtgacgcccagctccagggctcggtcgatggtggcgagggactcggtctcgtcggtggcgccgtagtgcgcgctcatgcccatcaggccgaggccctcggcgccgaccttcagcccctggccgcccagtgcgcggatctccatggtgtgctcctcacaggaaagtaactaaccggatagatagagtctgcgacgcgtcggctccgtttgtcaataactggatagttacttgctaggctgcggtccatggcacgggattccaacgcgaccaaggcgcgcctgctcgacgcggccttcaccgagttcgcgacgtacggcatcgcgggcgcgcgcgtcgaccgcatcgccgagacggcgcaggcgaacaagcggctcatctacgtctactacggcaacaaggaacagctcttcgacgccgtgctccagcgcgccctcgagaccggctccgagtccgtcccgttcgacgtcgacgacctgcccggctatgcgggggcggtcttcgaccacctcgtcgagcggccggcgctgatgcgcctcgtgctgtggaagcaactggagcgcccggggtccacggacgcggagtcctcgtcctacgacggcaagatcgcggcagtccggcgggcgcaggaagcgggccggatcgacgccgcggtgcccgcggccgatgtgctgaccctggtcatgggcctgtcgcaggcctggttcggggcggtcggcggcccggccgccggcgcggcaggcaccgactgggccgccgagcggctcgccgagcaccgcgcggcggtcgtggaatccgtccgccggatcaccgcaccgcccccggccgacaggacctgagggcgcccgggggcgcctgtgtcccggaatgcccttgacctcaagcgcggttgagggttgatgatcgcgtccatgaacaccgaacaagcaaccacgaccgcctccctcgaagcgatcgcgcaggtcgtcgccacagtggaacgtacgcaacgggccaaggacgccgaggggttcctggcgctcttccatccgcaggccctgtggaccaccggccacgggaaggtcctcatcgggttcgaggcgatagcggagttcacgcggacggtgctgccgacggccgactgggacggggaggtcacctacgaggtggtccacacccagttcctgcgtccggatgtcgcggcggtgaaggtacgccagctctaccgctcgccggacggcgacaccgagggcgcaccgctctacgtgatgacgtgcgagccggacggccgctggctgctgacggcctgccagaacaccccggtggcggccgacccggcctgaagcacacgcagatgacggcggtgcaggtccggcagcggcggtgaccgggtgcgaaccccccgccggctgccggacctccggcggacccgatcaggagcgggcgaggaacgtccgcaggaccgcgccgagttcggccggcgcgtccagcgcgatgaggtgggccgcggcggggaactcgaccagggtggcgccggggatcccggtggcgtaccggcgggcgatgtcctggaagtcggcgacgtcgagcaggccgatcccgacgagcgtgggaaccgcgatcgcggcgatgtccgctgccgcgccgcccagggagtgctccccgacggtgtcctggttcaccagcgacgtccgtaccggggcccggagttgctcggccagccccggggccacgtcctcccagccgcggccgggcccgcgcagccacatgtccaggttcacgccgaccgcggtgtccaggtcacccgcggccagggcggccgtctcggcctcgtcgtacgcgaccatgtccgccgaccagtcgtagccgggccacggcggggcgagcagggtcagggaccgcacccggccggggtgggcgagagtgaagtcgacggccacccggccgccccaggacgcgccgatgagccggacgctttcgtgaccgaggtggtccaggagccggcccaggtcatcggtctcccggaacggcccggccggaggcgcggactcgccgaagccgcgcaggtcgtaccggatgacggtgtgccgctccgcgagggcgggcacgaccgcgtcccacatggtgtggtcggcgactccggcatgcacgagcacgacgggtgagccctcgccggtgacggtgtaggaaaggtggccgagatcgtcggcaagaatgagcatccgcagatagtcacaggtcaacacgggtcaggaccaccccattggtgccccgggcggccgcgcgaccggactcgtgcgctcaccccgccggcaacgtgggccgggaccgtaattccatggacgaccccgtcggtgatcaagtatcgtccggtatcggatcacgtcccaccagacgatcaaaaggaggcgagtgccgtgcagttcaccatcatccagcgctccctccccgtcagcccggtgtggttcgtctgatccgagaccgggagcgctccacgcagtaaccgtcccggaggattccatgaccgatctggtcatccgcgcgctcgacgagagcgacgcccacctgttcgacgcacacccggacccgctgaacgcccgcgccgcccacgagcgcaccacacaccgccccgactggaagcgggtggccctgcgcgacggcacggtcgtcgcccgcggcgcctggtggggcggcgccgacgacaaggaacccgtcaacgttaactggttcgacgtcgccgagggcgaagaggaggcgggagccgaactcctgcgctccgcaccctggcaggtcgagctcgaaatcaacctccccggcgactggcgggaccaccccgacctgaccgccgccaccgaggcgcgcttcgccgccgccagggcggccggctacgagctgctggtggaacgcttcctctaccgctggaccccggagcgcgggctccccgaacggcccggccgcctcgtcttcggcgccgaacccgacgacgcggtcttcttcgacgccctgcgccgcatccactcggccaccctggacgcccacgcgctgaaggccatagcggagggcggactcgaccaggccgcccaggaggagctcgacttcttccactggtgcccttccccgagggagtggtggcaggtcgcccgtacacctgagggcgatctggccggcatccacatcccggcgcacaacccctccgggccgaccatcggcttcatcggcgtcctgccggaacaccgcggccgcggctacgcgtacgacctgctcgccgagtgcacccacttcctggtggagcacggcgccgaggccgtcaccggagccacggaccggggcaacttccccatggccgcgaacttcgccaaggccggattccccgtggtgcgcgagcgcgtcaacttccaccccgccgcggccccggccgcgtaggcgaggcggccccggtcctcgccccgcgccgaccccgttcgggtcgcggggcgaggacccggcgcgcggccgaccgcctgccctggggccgctccgtacactgacggccatggcatgccgcatcagtgagctggtcgtcgacgccgccgaccccgaccgcctcgccgctttctggagcgaggtcctcggctccgtcgaaatcggccgggaggccgacgtaagcatcgagatcgggccgcccgacgccggtttcggcggcccgcagcccaccctcgtcctcagtgccggcggcggcccgcggaccgggaagctccgcctgcacatcgacgtcaatcccaccgaccgcgaccaggacgccgagctggcgcggctcctggccctcggcgcccggcccgccgacgtcggccagaccggcaccgagacctggcacgtcctcaccgacccggaaggcaacgaattctgcctcctgcgcagaaggctcccgcccctctgaccgtgcgcgtgggacggcccgccccgggccgccggctcttgaccctcacgcggcgtgaggccgcatagtcggagccgtggaagatcactggaccgtgggacgcgtggccgagctggccgaggtgagcgtccgcacgctgcatcactacgacgacatcggactcgtccggccctcggcgcggaccccggccggctaccgggcctactcggcgggcgacgtggagcggctccgggaggtgctggcctaccggcggctcggcttcgggctgcgggaggtcgcggaactggtcggcgatccgcccaccgacgcggtcgcccggctgcgccggctgcgcggcctgctcctggagcggcgtgagcgcgccgacgccatggtggcggccatcgacagggaaatcgcggcacgggcgagagggctgaaggtgacaccggaggagcaactgggaatgctcggcgcccggctgtacgacgcgatcggcggcgcctaccccgcgacacggcgtaccgacccacggatcgccgcgcagatctgggccgcgctcggggacgcgcggaccgtgctgaacgtcggggccggcaccggctcctacgagccctccgatcgcgaggtgaccgcggtggagccgtcggcggtcatgcgggggcagcggcctgccggggccgcgccgtgcgtggccgccgccgcggagaacctgccgttcgaggaccggtccttcgacgtcgctatggccgtctccaccgttcaccactggggggacccggcagcagggctgcgcgagatgcgccgagtggcccgccgcgtcgtggtgctcaccttcgacaccgacgagcccggatggcaggaccggttctggctcacccgcgactacctgcccgaattcgccgacgtcctcggggagtttccctcccttgccgcgatggccgacgcgatcggagcccgcaccgagccggtacccgtcccgtgggactgcgccgacggcctgttcgaggcgtactggcgccgcccgggggcgtacctggaggaccacgtgcgccgtgcgatgtcggtgtggacgagggtcggccccgaggccgaacagcgggcggtacggagcctcggcgacgacctcgactcgggccggtgggccgagcgcaacggcggcctcgccgccctcgacgcggcagacctcggcctgcgccttctcgtcgcctgagccaccccgcagccgagtcccgcgtcagtgccggtcggggaggtgccagcggtgcggggcgacgagcgcgtcgatgctgtcgggcccccaggacccgggggtgtacggctccacgggaggaggtgcgtccaggagcggggcggagatctcccacaggcgttcgatgccgtcggaccgggtgaagaaggactggtcgccgagcatggcctccaggaggaggtgctcgtaaccctccagggagttgtcggcggtgaaggagctctggtagccgaagaccagatcggcctcggccaaccgcatcgaggggcccggctccttgacgaggaaccgggcggtgatggagccgggatcggcgaagtcgatgacgacttcgttgccgcggccgtcgaccgccgcacgcgcgttcagcgggaacatcccgaggaccggctcgcgcagacccagggtgacgacgtgccggccctcggccagcgccttgcccgagcgcaggaggaaggggaccccggcccagcgccagttgtcgatctcgacgcgcagggcggcgaaggtctccgtgtccgaggcggcatcgaccccgggctcggcgcggtagcccgtgtactgtccgcggacgacgtgcgcgggatccagcggccgcatgctgcggaagaccttcacctgctcgtcccggagcgactgcgcgtcgaggacgaccggcggttccatggcgacgaatccgagcagctggaagagatgggtgacgatcatgtcgcggaaggttccggtgccctcgaagaagtgcgcacggccctggatgtcgatctgctcgggcacgtcgatctgcacatggctgatgtgctcgcggttccacaggggttcgaaaaggccgttcgcgaagcggagggcgaggatgttgtccaccgcctccttgccgaggaagtggtcgatacggaacacccgggactcgtcgaacacggcgtggacggccgcgttgagtgcgcgggcggaagcgaggtcggtgccgaagggcttctcgacgatgacgcgggcgtcccgggccaggcccgtggcgccgaggagctcgaccatcgaggtgaacgcgacgggcgggacggcgaggtggaacagccgacgaggagtgccaccgacggcctgctcggccgcgcgtaccgcctccaccaggggctccggagcctgcgcgtcggccgatccgaaggacagggcggattcgaactcctgccatacggggccctcggggcgcgagcggccgaactccgtcacggcctgtcgcgcgtgggcgcggaactcctggtcgctcagggcctcggcggccggggcggagccgacgatgcggtagcgccgcggcatcagccccgccttggcgagatggaacaggcccggcagcagcttgcgccgggccaggtctcccgtggcgccgaagaggacgatgacgtggtcggccgggctcgactcgggggctgaggccatgcgccgcacttccgttccgggcggtcgcatcgccctgagcacccactgtgcgtggtcaccacggatccggcacccgggattccaccacccgggtcatggcacgccccgtccgtttcgctgacggccgggtgtcaccctcggtactagtgtcaggtcgtgggagagcctctggagcaggtcgaaggcgcgggaccgttcgtcacccggcgcacctggcgcggccccgaaggggagacggtggtctgggactcgcggccggcgagaaagcgcggcacgctgtcggtccggagcccgggggacaccgccgaccgggtctcgaccgccgatcccgcggcgctgcgccgtctgcgcaggctcaacgccgtcgcatccggtgcgttcgtcatcggaggagcgctgttcgccgtcggcgccgcggtctcgcagttcggttcgggtgatccgctcgtcagcgcgtgggtgtacctcgtcgggggagtgttcttcagcaccgggggctacgtctccatcctgcaggtgctgaacgcgccccgtcacaccccggacggcggctccctggtcacggccggctggcgctggtggggatacgagccgatgagggtggactggctgagcatgttcgtcctgttcacggggacgctcgtgttcggcgtcaacctgctggactccttcctggagggcctcaccgtccggcaggtgaaccggctgatctggacccctgacgtgatcgggtgcgtgctgttcctcgtgtcggggcacctcgggttcgccgagatctgccatcggccctggccgtgcgtccgctcccgcagcctcggatggtgggtcgtggccgtgaaccagctcggctcgatcctgttcatggtgtcggctctggccgcctacacccgccccgccaccggaagcctggtcaacgtcggcatcgccaactgggcgaccctgacaggtgcgctgtgcttctcggtcggcggagtgctccagctcttcgaacgcccgtaggcggcccgtccggtcgtgcgcctactgcggatcctgcctccccgcaccgcgccgccgcacgacggtgtcgacggcgtcgacaggtcgcgggcgagcgcgtagatccggtaccgggctggcagtgactcggcccgcgccgacatcgctttcccggccgcgacagggtgccgttcccgcggtcttgtcggaagatcacaagttccgcgatggccggtcggctccgggctacgctccccgctccgggggtccgcggtacctgcgccatacgggcaaccacgctgaacgcccgggcctgccccgcccccgcactccctctgatggaaagccctgctctgttgaccctggcagaacccccgaccacggcccggccgctcgccacatacggcgtcgtactgggcagccgacacgttgtccgcctgctcggcggcactctgatcgggcgcctgcccaactccatggttccggtggggctcgtcctgtggatcaccggcggcggggggaccctggccttcgccggaacgctcgccgctctctacggactggcttccgcgctgtcccagccggtcaaaggcaggctgatggaccgttacggtcaaacccgggtgtcgacacccgcggtgctgctcaacgccggctgcctggcagcgctccccttgatccgggcgtgcgggcaccccgcggcggtgaccggggtggtcgggctcgcgggtctggtcacacctccgcttgaggcagggcttcgggcactttggccgacagtcctgcccgacttcgggcggcgccgagtcgtccaagccctcgacaccggctcgcagggactcctttacatcgccggccccctgctcgcctcgtggctggcaaccacgcacgggcccgacaccgccctggccgcgaccgccgccctcgggctggtgggcacggcggtcgtcctgaccgccgcaccatcgcaggcctggcgccctgcctccggcgtgacggaaagaggacggctgatgagcgtcggcctggtcctgctgctcaccgcgatggcgggaacggggttcgcgttcggagcgatgaacgtgtgggccgcaggcatggccgccacccacgggcaggccatgctctgcggactgctgcctgccgtgttctccaccggcagcttcctgggaagcctgatctacgcccgccgggcctggcccggcacaaccaaatcccagctcatcaccaccagcgccctgttcctcctcggctggtcgcccctgctggcccagcccgatccccgcacagccctcgccctcgcggcaatcccggggctgttcttcaccctgatcatcaccaacggcttccacaccgtggacgcgctcgcctccgtctcccgtaccaccgaggggtactcctggctgatcctgtcggtcggcaccgggcaggcggccggaaccgcgttcgccgcaaccctcgccgcccaccccgatgtgctcgcggcgctccccaccggcggcgccgccaccgcgctgacgatcctcgtcctcgcccgccgcaagctcggcccgggccgccgcctcggccgccaccggcgtacccgacaagaaggacatcctcgccgaacgccgccaccgactcgatggcgagcagcgggcacgcgctcgctgctctcggcgtcgaccggctgtgaaagggcgctgcgcgccctggccggtcacgctcgggggaatcggcgtcgccgcaggcgagggccgctggaccacccggcggcccggttaccgtaccgagcacatggccttctctgatgggccccgcggtctcggtggggagggatcgggcgggtccccaccgagccgggtggcgctctacgcctcaggcgcgcacgcgtacgcgtgcactcgccgtcagcagggctttacgtagccgacccagtcccagggcgcgttcgggtcaccgacggggccgccgggggaggtccagccgaggttgccgtcgtggccgtagaacttcacgtgatagttggagggctggttgttgtaccaggatccggtgccggtgtacccgatggagaccttgtagcagtcgtacagcccccacatcctgccttcgtagttgggctgggggtacaggcacacccagccccgcttgcagggatcggcgaacgcccccgcggcatcctgggcgttcaggtcccgggcacgcttctcgccggggaggggcaggaccaggacgcccttgccgtcgagatcgatcttgtttgcggccacttgccggccgccggcggtggccagttcggtgtcgatccggcgctggagttccgccgcccggctgtcgtccagacccgcggcccgggcctgtgccgagaagtcggcgtgtgcgcggtcgctcgtggcggaggcggaggcgggagctgcggaacggatgctcgcgtcggccgggcccgcgagggccactgcgccgaggagcgccatacccaccgccgtcaggcgtgtgtggaacgaggacacgaagtctcccatcgtcgtcggggcgaggcggcgccccgacgacaccgctctcgccacgaagactcacgccgggcggggtttggccgcccgggcccgatggcgttcacgcagttcgcatgcggtgcggtcggcggacaacgcggttgtccgccggacaacgcgctcagcctgacgcggcgatggagccggccgagaggcccagcgatgtccattgcgtaccgcttcccgtccagcgggagacctcaagccggctgtctacgcggtagaccgaggagcccacggcgaggctgacgcccgcggtaccgatggggctccacgcacccggcgccccgtcgtatttgaggatctgcccggtggcggcgtcgacggcgaagaggccggcgctgcccgcgtacaggttccgggccggaccgccgatcgggcgccagttgctgcccttggcgttggcctgccagatctccttgccgtcgggggagatccgggcgacgtaatcggggccgacggcgaagtcggcgccgggtccgcctgcctccagccatgtgtagccgtacccggcgtagcggaacaggccgcccgtctccgggttggtggcgaagagcccggcgccgcccgcgtacagccgggtggccgcgccgccgatggggatccactccgctcccaggccggtccaccgcatcaccgcgttccgctgctcggtgatcgcgtagaggccctcgcccgccacgacgaactgctcgccgggggctccgatctgggaccaggagctggaagcctcgtcgtgcttgaagatgcggccgtcaccggggctggtggtgaagaccccggcgggcccggcgtagacctggtcggccgcggggccgatcaccttccaggcgctgtcgcgggcggtccaccgcaggacgctgcggtggtccggcgagacggcgtaggcgctgcccggggactgctgcgggggcggggacggaggtgcggtgggacccggggtggggcccgcggtggagggcgaaggctgtggcgccggtaaaggcgggcccgacggtacgggcgaggcagtgccggtcgttgtcggggacggggacggggacggcgtgggggacgcggacggggccggggcggcgcgcggggccaaggggcgggagtggggccgcgcctgcgtcgcgccgtttgcggccacggtgcgctgccgtccgacgaggaccccggcgagggctgccgacgcgatgacggcgaggacggtgcaggccgccagggccgcgagcagggaccgggcggtccgcgggcgcggcggcggaccggggagcggggcccgggccgggaccgcgggaagcctgtcgagccgttcgagaacgaccccctggacggtaccggagtgctcccggccggcccgcgtgcgctcccagagccagtgcgcgtcctcgcactgctgctccacgaggctgtgcagccgggccagttcgacggacagggcccggtccgccgtggccgcgggcagggcgtcgcccccgcccccgcccccgccgtcggcccgcggcggctggtccggagccgcgagggccgggagccggaggccccgacgggcggcatcgccgtgggagcgggcctcggcgaccgcctgccgtacggcttcttcggcctcccgggcagcgatcagctggtcgagcgcctggtccggccggagccgcaggggcacggaggccgcagcagcggagtccgtacgggcggggggctccgcaccgtcgtcctccggcgggtcaggcgggtccggcggggcgactttggcttgttcctggagcatcgtcatcagcaccagcagcccctctacgagttgccccgatgcggcgaggtcgtcctgtgcccggcgaagcgcgtcctcaagcccgggcggcaccgtggccgccgcctgcgccgtgagcgcctgaccgtgcagctgccgggcccgggccaggagctcccgcctgaggcggggatcacggacgcggtccccgaccacgatgccgaggcgccccagcgggatcacctgggcgccggaccggtattcgctccaggccgtcttgccgcccccgaagcgctgggcgagttccctcaccgtcatgccccgtgtcacgtcccgcagcagcccggccaactcgttggccgcctgcgagcgaccccttggagccccttgtggacgccctgtcttcgccatgtccgttcgccccccatgctctcggcgggcacaggcaaccgggtgagattgaccatgtccatcacaaggcgacgcccttgtccggatccccctcccgcgtccgccgctcgccgtgccgcgcggacaccgcggaaacccagtgcacgggatcaggccccagccccgcacacgtcccgtgaattccgggcggtcgattgtcagtggcaggtgaaaggatcacgagatgcctctgcctcagcccgatgatctgacctcactggtcctgcgcaccgacttcggtgacgagggagcctgggatgcggtcaaagccgcactcgacgcggccggcgagtaccgccatgccacgtatgtgagccagcttcgcttcgcgggtgtgggggtccagaccttgttggccgaagaggatgcagcggatgaagacgaccagatcgtctacatgtttctcgcggacgcggtcacgatgaacgatcccgctcacccactgctggccgtggacctctcggacgagcccgggcggacgttcagggtcaccgctcgatggtttcctgacatctcagccaacctcagcatcgccaacatggactttgcggagttcgccgacgccgctgacggatcagggaccttccgcggctttgacgagggctgacgtcttctcgttgctctgctcacgcttcactcacctcgacgtcggtgaagttcgagggacgtggacgcagaacaaggaaggcatcgatgacaccgctggacctgttggtcaagcagcatgtggccccagtgatgaaagcggctggcttcaagaagtccggccgcaccttccgcctgaccgcgagtaacggtgaccaagccgttcttgggttcgcccgtcacaacatagaccctgatgcggccgtcttcgaggtcggctaccgcatcgtgccggcgccgtactgggagtggattgaccggcactcggccatcggcagcgcacgagcccccatcgccttcggccccgcagtgctcgtcggcagcgtgatcccgccgactcaagcagcgcatgctccggaccccgcgatgtcgtttcgtgagcgctgggccctgcgtgaggacaaccgcctcgcctgcggcgaggccctggcgacggtcctgcatgaggaagccgtcccgcagatcgtccatcttctcgatcgcggcaatctcctgcaggagtgccgccacccggccctgccggtcgtgcgactcgtgccgctcacgagagtggagatcctccttcgagttgatgacgctccgtatgaggagatcgaatctctcctggccgacgtgcagttggccagcccgcacgacgacttcatcacctggacgcgccaacggctgacagcaagaaatgctgtacaaccagcggccacgcgctcatgagcggctcctgcgcagacttcgcagaaagtgcgcaggtcacccatcgagtctccgctttcccgagacgtgtcagcctgatgggcaggcatgcccgtcggattctccggacaggtaggacgcccgttcgtctgcggccagatcgcgacggacggcctggcagatcttccggatcgctgcatcgggatcgggaagcgccgcgttccacagccgcgcggtggtgtccccgctgccactggcgagggtatgcccgtcggggctgaacgtcagagacgtcaccgcattggtgtggccggtgagggtggcgcgggtctttccggtacgtacgtcccacagccgaaccgtgaagtcgttgctgccagaggcgacggtgcgcccgtcggggctgaaggccacggaatcgaccttggcggtgtgacccgtcaggggagcccttgccttgccggtggcgacgttccacaggcgtacggtcttgtcggagctgccggtggcgagggtattcccgtcggggctgaacgccacggatgtcaccctgtccgtatggccggtcaggggagcccgggctgttcgggcagcgaggtcccacagccagaccgtcttgtcatcggcggcggcggcgatggttcggccgtcgggactgaacaccacggaccacaaaccgccggtggcatccggcagagtggcgcggagctttccggtggctgcgtcccacagtcgcactttcatgtcgccgccggcggtggcgagggtgttcccgtcagggctgaacgccacggacagaactgtgttggggtgaccggtgagtttcgcccgcatttttccggtggtcaggtcccacagccgtgccgtgttgtcgatgcttccgctggcgagggtgcgcttgtcgcggctgaacgccacagatgtcacctggtcggtgtggccggtcagcggggcccggggtttcccggtgtccacgtcccacagccgtacggtcttgtccgcgccgccggtggcgagcgtgtccccatcgggactgaacgccacggacatgatcggatcactgtgaccgctgaggggagcgcgggcagctccgctggtgaggtcccacaaccgcaccgtcgcgtccacgctgccggtggcgaggccgctcccgtcggggctgaacgccaccgacgtcacgggctcggtgtgaccgctgagaacggcacgggcctttcccgtgttcgcgtcccacaaccgggccgtcttgtcctcgcccgccgtggcgagcgtgctgccgtcggggctgaaggccaccgagaacacacggaggagttggtcgggcagtgtcacacggggcttcgcggtggtcaggtcccacagcttcactgtgtagtcatggctggcggtggcgagggttttgccgtcggggctgaaggccaccgagaacacgggaccggtgtggccgatgagcggggcgcgctcttctcccgactgcacgtcccacacatgcaccgtcgagtcggcgctggcggcggcgaaagcgcttccgtcggggctgaaagccaccgacatcacggtgtaaccgtcgctgacggggagggtggagacacctacttccttgatcacgtcccagaaccgcacggtggcgtcgttgctgccggtggcgagggcgctgccgtcggggctgaaggcaaccgacgtcacgccctgggtgtgaccggtgagggtggcgcgggattcctctgcgtccacgtcccagagccgcaccgtcttgtcgatgctgccggtggcgagggtgcgtccgtcggggctgaaggcaaccgacgagaccttgtcactgtggccgggcagtgtggcacggagtttcccggtggacacgttccacagccggaccatcgtgtcttggccggcggtggcgagagtgcgcttgtcggggctgaatgccacggacgcgacctcacccgtatggcccggcaggcgctgcttcagtggcagggctgccgcgttttccaggctggcgagggcttcaggggtgtgactggcgcggtaggcgcggatggcgagcagcgaggcgaggtcggggttcgtgtcgatgagggtcccggactgggtggcgagctgtcgggacagggctgcctgccgctcgtcgacggctgttcgccactgccaaactacgccggccgcggcgaggagtgcgaggacgaggagggacgcgaggatggcgatgaggcgcctgctgcgtcggatggcggcctgctggcgctgctcgctggcgttgaggaaggctctgatgtcgcctggcaggcgccattcgcgtgaccagtcgagccccgcggcgagcgctgctccgctcaggagctctcccgggtcggatgtcgccgcccagagggctcgccgctcacgggtccggttgaaccattcatggaagagacgatcctgggcgacccattcgcgcagcgtgccccactcacggatgagcgcgtcgtggaccagttcggccaccggctcgcccggaggggcatcaggcccttcacgagggcgcggcatctgcgtggtgatgatgcgatggagggtcaggacgccgatgacgtcgtcgacgtgcccgtcggccgtgtcgtcggggtcggccgccaggtcgcgcagctcgtcaaggggaagctgggcacgtacggcaggtacgttgcggccgggatcctccggatgcaccaaagaggtcaggatgcgccgggcgatcgggtgttgctcggagggcagccggctgagggtgttgtcgcaccatgtggtcaggctcccgctgaccgctccgatgcgccggtaggcctcgtgcgtgaggtagccgtcctctcgccgggaccacagttggctgagtgccagctccagcaggggcagtaccgtgacgggggcctggcgggccatgtccggggtcacggccagcacatccgtgacgatctgctccaccagacccggctggaaacggagtcccacgtcctgggcgggcagggtgatgatgtcggacaggtcctgctggctcagggtgcccggcacattcaggagacctggcatcgcggtgtccagaagctggggggccagagccgccagctgtgggtagaagtcgtcccgcatgatcaggatcacgctcagcccgaccggggagccgacggccgcggtgatctgttccaaggaggccaggccgtcctgccgttggccgtggccgggctgggtgaacagctcttcgaactggtcgatgaccaggagaacacgctcgtaaccgtcctccgccgagagccgacggccggcagcggcggcgatgccctgcgtgaccgccccggggagtccggcgcgctcgatctccgccaacaggttctgccggggcctcgcgatgacgggcagccagcggtcgctgccgggcagctcaccagcggccagcgcctgcaggacgcctgcctggaccaaggacgacttgcccgaaccggagggtccgagcagcagtgtcagccgccgttgaccggccaggttcgcaaccacctgccgcaccgcgtctttgcggccctggaaccatcgggcgtgttctgcggtgaagggctgcagttcccgataagggcacacctcttgcaccgcgaggtccggcacgatctcccgcagcgtctgcgtagcagtgacgtacgcgaccccttgcccccgtcggaggccgtcgggggcggtgatctctgcgagcatgccgacaaccagaccggtctcctcatccaggaccggcgcgccgctgaagccggtggtgagatcgttggcgccggtcaactgcagatggatgccccgctggggggagggaggcagcagatccccggcttcaccgaagccgagatgacccgtctgcggggcctgcgcggggaacccgtacgagcgcaccttgtggccgctgcagccggccgcagagcccagcggcaacggcttcagaccgggaggggtgctgctcaggcggacgaccgccacgtcttcgtcctccgaggcacgccacatctctgtcaggaccagcccgtccacccggggagcatcctccaggtggggaaagcgcagccgtaccggtgtaccgggcccccctccggcaagctcgacgacgtgggcgcaggtgacaagcagtccgtcggccaccaggaagccggccccggcgacctcttcgtccggtccgaggacctgtgccacggaagcgggcaggcttcccgccgtagccccgtcgggtgtcttcgcggtgccggtcatcggatcacacctgctggttccttggccggaatccagcccccgccgtcccacagaagtcgggtcaccggtgccaaggcggcctccttctgtgtgctgcgatgctgccttcgtcccgcagatgccgacagtcggtgtgtgcagggtcccgttctgcgcaggcaccccgtccagcgtcgtcaacagcggacgccgccgcatcctcgggtaggccgcatgcgtgagcggttccgccggtccggcggacgacgcgccgtgagacgggggaccgggtgagcccgaggcgttcggcgaagtcctgccgtcggatgcggaggaggccgccttcgttctggcaccaggtgcggtagccgcagtaaaggtggcctgttcggcccggtggccggcgtggaaggtgcagcgttcttcgaagaagcggccggtgtggtcatcggctgtgttcagctccagcggtgacatcctggacgacggcatgccccggcactccaccctcctgctcgactacccgcaggacgagggtgcccggcgagcttcgtgtgggcgggcacgcggcccccgggcgcgcgcccccgggcacgcggccttccccgggcacgccgtgttctcgtccctgcaggcttgatcaagccatccgttcgtcacctgaacagcgcagcaggacctagagtgtgcccgtgaccgagcacaatcccgaactcatcgccggccggtaccagctggtcgaacgcatcggccaaggcggcatgggccgggtctggcgaggcgtcgaccagcagcttttcgggcgtgaggtcgccgtcaaggagatcctcttcccgcctggcctggaagacgccgaccgcgccgcgctgctccggcgattcacgggtgaggcgcgcgcggcggtcactctcagccatcccggaatcatcaccatccatgacgtcgtcgagcatcgcggcgcccccgtcatcgtcatggagctggtccgcgggcagtccctggccgccaccatccgcagccggggccgactgcccgtgcaacgggtggccgaaatcggcgccgctgtgctcggagcgctcgccgaggcgcacggggcgcggatcatccaccgcgacatcaagccggacaacgtgctcctgaccaaggaccgcgtcgtcctcaccgacttcggcatcgcccacctcgcggacgccacgaccaagctgagccacagcgggacggtcatcggcacgccgcagtacatgccgccggagcagttggagggcaagcgtccgacccccgccaacgacctgtgggcgctcggtgcaaccctctaccacgccgtcgaggggtgcccgccattcgacgtggaggggctccacgccctcgccgtggccgtgttcacccgcccgcaccggcagcccctccacgccggcccgctggcgcctgtgctggacgcgctcctcaccaaggacccggcacagcgcgtgggcgccgcagaagcgtccgagatgctggcgtcggtgctgcggtccttcccgccccacaccgatgtgcccaccgggcatgggcccggccaggagcccgcgcccgaacccgagcccacgcccgatccgagggctacccccgtaccggacgcggcggcggagcatccttccactccggccgtgccggagcaggcgccgtcgacgacgccgtcaccgcggaccgccacagtcgtggactccgggtccgccgccggtacacagccgcgccccgtgccggaccggccgagcggcccgcccgcgcccgtacccccggccgaggcaccggtcattctcggggcggcggccgagacggagcacggcgggcggaagtccgcccggcggcggggcctcacccggcgctcagcgatcctgagcgcggcgctggccgcgctcgccacgggctccgccttgacctggaccctcacgtacggcgatgacgcgcaccgcggcggcagggcggccggcagcggctcggaggcttcctccgtcacggtggtgatcggtgtggacgcaccgctcagcggcggactgtccacgatggggatcggtatcaggaactccgccgacctggcagccaggacggccaacgaaacccggcacgtccccggtgtgaacttcgagatcaaggccctggacgacgaggccgaccccgccaacggcgagtccaacgccgcccggttcgtgtccgacgagaaggtgctgggtgtcgtcggacccctcaactccggcgtggcccggaccatggtggcaccgctcgcgcgggcggagctggtcaacgtatcgccgggcaacaccgaccccgtactgacgctgggccccgactgggccgcaggcagcgcgtcccgtccgtactccacctacttccgcaccattgccacggacgtcgaccaggggccgttcgccgcccggtacctgcacggcgacgcgaagaagaccaagctctacgtgatcgacgacgccagcgcccacggcaccaccctgacctccggattcacggccgaattcaccaagctcggcgggaccgtcgtcggtaccgagcaggtcgatcccgcggaacgcgccttcgcgggcctcgccgcgagggtgcggtcctccggcgccgacgccgtctacttcgccggcttctacgacacggcggcgccgctctcccagcagctcaagcaggcaggcgtgaacgtccccctgatgggtggcgacggcattttcgaccagcagtacctcacggcgaacccgaacgccaccggcgacctcgcgaccaacatcggggtccccgccgaggagtcggctgcaggacaggacttccttgcccggtaccgcaagacggggtacccggagccggccggctggtacggcccctacgcctacgacgcgacctggaccgtcatcgaggcggtgaaggccgtcgtggcggccaacggcggcaccctcccacgcgacgcccgggcgaaactgcggcaggccgtggcgcggacggccttcgacggtgtcacgggccgcgtcgccttcgacgggaacggcgacacgctcaaccgccggctgacggtgtacaaggcgaacgacggcagctgggcgacagtgacgagccgacccgccgcccgctgagacggccagggcgatgtggcctcacccagcaggagctgccgaacacctcttcgcctggcggccgttcgtccgcggtcagaccccggctgccgtcacacatcgccggtcaccgcccccgtcgacagcattcggcccggctccggccggccgccgcccccggaccacggcccccgtgaaccccggccggatgcctgcgggccgcccggttgctgaagcgccgggtccgtgcggatcgtgtcgccgagggggcttcggctgtcggtgctgaggccccctgcggacgggcggtcacctgtcgacggcgtcggtcacccgagtccattcgtccaggtctgcggtacgggcctccagggcggtgcgcatgcccgtggcactggaggtgccgagggccaggcgcagcggggggttggggctgtcgaccgtcatgcggatgccttcggcgatccgggccgcggaggagaacgcggatgcgggcagttctccgatgcccttctggacctcgcggacggtctggtcgtagtcgtcgaggccggccgcgacatcgaggttggacaagaagggcgtggcggtcagtccgggctggatgatcgtgaccttgatgccgagcggtgcgacttcggccgccagtgcgtccgacagcccctcgagtgcgtacttcgtcgcggccagcagtcccacgccggggtgggcggactgcccgtagaccgaggagccctggaggacgtgtccggatcgctgggagcggagtactggcagcgtcgcgcggagcacgttgagcgctccgaagacgttggtgtcgaacacggcgcggacttgtgtgtcggaggcttcctcgacggctccgaagagtccgaagccggcgttgttggccacgacgtcgatgcggccgaaccgcgagagcgtgcgctccaccgctgcccggacggcctgctcgtcacccacgtctgcccggatgaggagcaggcgatcgccgtgcgcttcggtcaggtcgtccaatgaggccgtgttgcgggcgatcgccgagacggcttcgcccttcttcagtgcctggagggtcagttcgcggccgatgccggaggtcgcgccggtgatgagccatgtgcgggggctggcctgctggttcgaatttccgttcatgttgcgaccgtaaggcgttaactcgtaacgagtcaagcgtgtggccgctgggcgttgcccgttaggcgacttagcgcctcgttggctggtgtagggtggagcgatgagcagtgcttcaggcggatccgcgaaacccaggccgcacgccgccatgccggtggtggaaaccgtgctcgcgttcgtgaacacgcgcgcggacggaggcggccggcaggagctgttcggggacgggcactcattcgaggcgtggctcacggagcacgacgagttcggcggcggccatacggtggcgaccgatgccgatgccgcggccgcacgcgagctgcgtgacgccctggtcaccctgctgctcgcgcactcgggcgacgaagagagcctgggcgagccgctccaacacgccgagcagcacctgcggcgcgcaggtgcgctctacccgctggcgacggtggtcacggccggcggtgtcgaactggcgtcgccgcaggcaggcgtgccgcgcgtgttcgggacggtactggccgcggtgacgaccttcgcgcagaccggcgactgggggcgcatcaaggcatgccgcaaccccccgtgccatttcggcttcttcgaccgcacgcgcaatggggcaggcctctactgcagtaccggctgcggctcccaggtgtccatgcgcaactaccggcagcggcagcgccgggagagtgagtccccacccgaggcgtgaggccgtagctccacgggtggcccccctcgaagccgaggccatggtttcctgcgcgggccggcgaggaacaggggccgactgcgagcccctgcgccgatcaacgcgatgcgtcgtcgaggccacccctttccgggctcataccctcgcctcggtggggccgttgccccgccgaagcggcgaactagggtgagcccatggatctacagggcgacctcataaaccacccacacgacgcgtaccggcacctgcgtgacactgcgccggtccagcgcatcgcagggcccaccggcgaaccggcatggcttgtcacccggtacgacgacgtgcgctcagccctcgcggatccacggctctccctcgacaagaccaacgccgcggagggctcctaccgcggcctggccctgccaccggccctggacgccaacctcctgaacatggaccctcccgaccacacccgcatgcgcaagctcgtcagccgcgccttcacgccccgccgagtggacgcgctgcgcgccccgatccgccggaccgcggacggactgctggacgtgctcggcacggagggccgaaccgacctcatcgccgcatacgcggccccgctgccgatcaccgtcatctgcgacctcctcggcatcccggacgaccaccgcacggacttccgcgcttggaccaacgagctcatcgcaccggaccccagccgtccacaggccgccaagcacgcgatcggcgccatgctcgccttcttcaccgagctcatcgcgcacaagcgccggcaccctgccgacgacctgctctccgacctgatcgaggtacgcgacagcgacggcgaccggctcagcgaggacgaactgacgtcgctcgccttcctcatcctcggcgccggatacgagaacaccgtccagctcatcggcaatgccgtacacgcactcctgagccatcccgagcatctggcacgcctccgtacggacccgtcgaagctccccgaggcagtcgaggaactggcgcgctacgagggaccggcgcttctggcgatccgccgcttccccaccgaggacgtggctatcggagacgtcacgatccctgccggggaaaccgtcctgctgtcgctgtccgcggccaaccgtgatcccgcccgcttctcccaccccgagctgctcgacgtcgaccgcgacgcctccgggcacctggcactgggccacggcatccactactgcctgggcgcaccgctggcccgggccgaggtcgagatcgcgctggccgcactccttgagcggttcagcagcctggctctggccgagcccgcgccccggtggcgaccgtccctgcgtgcccgtggcctcctcgaactgccagtggagtacaaggccgcggcgcggccacgcgcgtaagaacggcacgttgctgccagccgggggcgacgagatggactgaccggctgggaggtgagcgtggactcgactgcccgccaagacccacccgacggtcgagcaggctcagaagccgatgccactcgtgaccacggcccggcccgagcaggaaccgctcaccccgtccgcccgtcttgtccacggggttgccagagactcaacaccccttacgctcttcaccaccgaggtccgaggagatccatggtcgacaccgtcaactcgctggccgcccgtgttcacgaactactggtggaggtcatgaccaatggtcccgccgcggcgggcaccacgggcttccacgacgtcgtcgcgcgcgccacggcgctcggccccgacggcgcatggctcgtcgccgccggccactcgagcctcggcatcctggctgtcctgcgcggagaggcgaaccagggaatcctccacctcgacgccgcggtgacagccggttacaacgactgcgtggcgctccacgtcgcccccctgcgtccactgcacgacgatccccgcttccgggccttgtaccagcggatgcgcatcacccaggcggacctcgacgagttcttctggctgcaccaggaaacacagctcatggtgcgggacgcccagaccgcggccgtcgacaacatcggccgtctcgacaccggggtgtcgctgcttccgcaggcccccctgccgacccgggaaccgaacacccccggcgtcctggtcgcccgcatcgacctcgcggcgacccagaccgcactccaacaggccgccttgaagtcggagttccagcgcagctccggcaataccagcctcagtctcatcgacgactcgtgggactacgaccgcgccaggcgcgacgcctggcacaccgacgagctggattcccggcgcctgcgggccgccgaggcccgggctttcgtcgaacgccccggcgccggcaccctgctcatcccctgcccgccgctgggctcgatcacctacccgggctgagcaggaccgcaggaaccacacccgcacggtggccggtgaggcttcttcgccggctcccgtccgccctctcgcgcgaggctggtgagaaccggctgcagagaccgcgacgcccccgccggccggcgggggcgcggtgtccggtactcagacttcggtcagccagccttcttcaagaccgcccagaacaaacccgttctcgaagcgcaccctgtatctgatctgagcgccgactccggagtcgagccctccgtgccgaatgatctgctgacggagactgtcgatcaggccggccgtgtggccatcgaactggacgccgcggactcgccgttcgaattccgcgagcccctcctgggcgacgccgccggtttcggtcgccgagcccgtgacgatgccctccaggccctcggccaggtacagcggaccggggaagccgatcctggccgccgtgtcgtttgcggtgacctgcacatccctggtcagcttcaccttcgcgccggtctcgtacggcatgggtgtacccccctcgttcgatcttggccgtgacatggcaagcgtagtcgggatgccacggagggaaggggtgcccgggaagatcagaagccccatgacggtgcctgccggaccgtacggggcagcatgcgtcggccgccgcccttgagggcggagccgtctggtcctgcgaggtcaggccacgtgcactttcttgcgtcgctcacgggcgaactggtcacggtggtccacgaccgccgtcccgcttgcccgagttggcggggctgtgcgccggaggtgacgacaggggtccgtcgcgctcccgagcggggaaaaccactttggggcgccgggtgggcatggcaggcttgcgcggtgatcgttgagttggctcctggcttcctgacctggtacgacgtggacccagcccgtcaagccttcgacggtgcgtccgtggcgcagacggtgcgctcactcggaccagccggatgtgtgcctgtccgcccggatgtcccttccggggatcccgcgatgagcgcctggagtcgcggcgaggccaagtcctgggccgacgccatgtcgtatgcccttgtccagcagtacgggcgttggaccgtcgggtggcgctggtcgcacgacgagggggatttcgacggtggaccggtagggaactggtgctgtccgcgggattcgatcacgacgtcggaagagacactggcccgtgtcgaggcggccctgcgcgagtggcgcgagtggctggagtccctcgccggctggttcgaggcgtaccccctggacctgaccgacatcgtggaacagcggatcttgtgggagcgcgcggcgaggaatctgatcctgcaggtcgtcgaccgcaccgggtgcggcagcggctggtacggccactgccgccaagtgctcacctggttcctcgagcgctggggagtcgagcccgaggtggcccggagcctggtcgacgaggcgatcggcggacggttccgcagctggaccggtcctgacacggtggtggtcgacgacgtcgcggaacaacttgcgctctccttgcggccgtccaacggccggccccgcgcactcgcgccgactcaagaccacttgcagcgctggctcgctgtacgtgaatcggtgccgtggcacgagatcccggacggcggcacggacggaccggtggtgccccttcgtgacggcgtggcggaggacatccgggctttcgacggtgccatcgcccctgcccgagccgaaggcctgctcggcgccctggaactgctccgagccgacgcggcacgcggagcgcggctcgacttcgcactgctcagcagctggcagcagcacgtcctgggcaccacgcagccgccaccgttccgtaactcgcccgccttcgccaaagggagcagggagcgctacggcatcggtcccgacacacgggcccgcctcgacacgtgcctggccgggagcgcacccgacaccggccaccctctcggcctgaccgcccgcgccgcccgcgcctctctcgacgtctgctcacctacgacatgacccccctcaccgcggcagccgccgacgccctcgacgagttcgccgccgactacccgtccttcgtccgttcctgggaagaactcatcgccacccacctgaggtgagcagcctctgcgtcaacgcgccggctcaaggtcgttcgccctcgctgaagtggccggttgaaattcccccatcggcggccggcaggtggggagccaactggccgccgatggctaccgaccgtgaaatgtcagcttccgtgatgtgcgcttgggactggctcttgggggcggaaggtgcggcgatacgtgtcgggtgggacgcccacgctgcggtggaagtggcggcgcagcgtggtagcggtgcccatgccggtagccgcggcgatggtgtcgacggtggcgttggtggtttccagaagttcctgggcgtggcggatgcgctgggtgtggagccactgcagtggtgtggtgccggtgaggtgtttgaagtggcgggcgaggtggcgtgagctcatgcgggcccggcgggccaggtcctccacggtgagcggttggtccagtcgctccagcgcccaggggaagagttcgcccagggggtggttgccgggctcgggcaggggggtggcgatgaactgggcctggccgccgtcgcggtggggtgggatgaccaggcggcgggcgatcttgttggcgttggccgcgccgtggtcgaggcggaccaggtgcaggcacaggtccatggcggcggccttgccggcggaggtgaggacgtcgccgttgtcgacgtagaggacgtcggggtcgacggtggccgcagggtggcgccgggccagttcccgggtgtgggcccagtgggtggtggcgcgtctgccgtcgagcagtccggctgcgcccaggatgaaggcgcccgtgcacagagaggccacgcgggcgccggcctcgtgggcggcacgcagcgcctggaccaggtcggtgggcggttcgcggtcggtgtcggcccagccggggacgatcaccgtgtcggcgtgcgcgagctggtcgagtccgtggtcgggctccaggcggaagcggtcgacgtgtaccggaccgcttccgcagacggagaagtcataccaggggtccacgatgtgggtcagatcggcgccgaaaacctcgagggccacggacagttcgtagtggagcatgccgtcggtgacggccagcgcgacagagggcatgtccgaaactgtacgcgtcatgtcgtttccgacgctcgtgcggggtgctgccgcgaggacaggatgtgggtgtcaggccgcggcggatcgacaccgcggcggggtggttcgagtgcacaggagcagtctcatgggttcaggtcagctggtggcggtgttcggcgcgtacggtcacaccgggcggttcgtggtcgcggagctggccgcgcgcgggtacgtcccggtgccctccgggcgcaacgcccaggcgctgcaggagctggccgacgagtacggccttgagccccgggtggcgacggtcgaggatgcggtgtcgctggaccgggccctggcgggcacggtggcggtcatcaactgcgcgggccccttcgcgacgaccaccggtcccgtgatcgaggccgcgctccgcgcgaagatcccgtacctggacgtggccgccgaactcgaggccaacctcgacaccttcgcccactaccgggaccgggcccgagaagcggacgcggtgatcgtcccggccatggccttcttcggcggcctcggtgacctgctggccactgcggcgatgggcgactggaccgcagcagacgaggcccacatcgcctacgccctcagcagctggcgccccaccgccggcacccgcctgtccggtgccgtctcccgcgagcggcgcggggacgtccgcctgcgctacagcggcgggcagtgggagcgccgcaccgacgccccgcccgctctccagtggaccttcccggaaccgatgggggtccgggacgtgatcggggagttcacgatggcggacgtcgtcaccgttccccagcacctgtccatccccgacgtgaccacctacatgaccgttgaggcggtccgggacgtcgcagccccccacacaccggcaccgatcgccgccgatgaggacgggcgctcggaccagaccttcctcgtcgacgccgtcgtacgctccggcggagtcgaacgccgggcgacggccggcggccatgacatctacgccatcaccgcgcccctggtcgccgaggccctcgaacgcgtcctgaccggccgcaccaagtccgcaggcgtcgcctccgccggtgagatcttcgacgcaccggacttcctgcacgcactcgccccgtacatcgcactcgacctccacccgcaaggcgcctgaccgcggcgctgcacgacgcatgaccgttgctggatgcgtcgaagcggactccccgccaccttccgagcgcacacacatgcgcatgcgcggagttcgagagtctccgcttcgatcactgcgagtcacattccaactggccggccgtacacggggaatctctggtggccgcccacacctcgcttcgctcggggcgctccaccttgaccacggactcgtcgacggcaaaggcccgcagctgtcgaggaaggcccacctccgcccggttgacggaggccggcggcagggtgcctcccgaagccgtgaacatctgccttcggaactcggttctggcacagatcttggggagacgtcgcggagcgttaccttgatgttcgattgtgagggggcggttcgcgtgagaccgcgtacgccttgtcgttaggcgatcagaactgacgctccctcaggggtctgccggccgctactgcggctgcttgtcgacggtgatggtgctggtcatgcagaccgatgcaccgttctgggactcgttggtgttccccggaatcgatgatgtggatgtcgagacggtgacggccgggttcggcacggtcgaggtggtggcgagagggcgcgaggccgaggcgtcatgcccggactgcggtcgcgtctcgggcagggtccacgaccggtaccagcgccgactgaaggacctgccgctcgctgagcaggggtttacgatccggctgaccgtccggcgcttcatctgcgggtcggcggactgcccgcgccggaccttcgccgagccgttctcccggctggccaccccgcatgcaaggttcaccactcggctcaaccacgccttggagcgcgtagggctcgcgttggccgggcgggccggagctcgcctggctgcccagctgggcttcggcgccggacggatgaccttgttgcgcagggtcatggcgctgcctgatccgcagttcagtactccgcgtgtgctcggcgtggacgacttcgcaatccgtcgcggtcagacctactccacggtcttgaccagcgtcgaagaccatcgtgtggtcgatgtgctcccaacccgtgaagccggaccgctggctgcctggctggtccgtcaccccggcgtggagatcatctgccgagaccgggcgggcgcctacgccgaaggagctcgcctcggagcccccgacgctgtgcaggtcgccgaccggttccatctgtggcagggactcggccgggccgtggagacctgcgtcgccgcccaccgcgactgcctgcgccatccgtcacccagcggcatgctgccgagggccatcccggatcctggccggccgcaggacagctcggagcccgtcggccggcgagccgagcggaagaaggcagcgcacgccttggtccacgaccttcttgcccaaggtcactcacgccgggcgatcgcccggcacctgggctggggcctcaacaccgtcctccggtacgcgaacgcccccagctggcaggacaccttccgcgagaaccggccccgtcccagcaggctggacccctacaagccctacctggaacgacgcttcgccgcgggatgcaccagcgtcacccacctccacaacgaactcctcgccgacaacgcgcccgtcacctaccaaatggtccgcgcccacatcgccatcctccgcgggacgcctgccggcacaccgacgaggcctccgacggtgcggcaggtgaccggctggctcacccggcaccccaccactctgagcgaggacgaccaggccgctctgaaggacgtcctggcacgctgccccgaactggacacggctgccggacatatccgcgacttcggcgaaatcctcaccgaccggctcgggaccacactccccacctggatcgacgcagtcgacgccagccaactacccggcctcaccaacttcgcgctccacatgctccgagacctcgacgccgtgaccgccggactcaccctccactggagctccggcagcatcgaaggcgccgtcaaccgcatcaaaaagatcaagaggcagctctacggacgagccggcttccacctgctgcggaagatgatcctgctccagtagcaacttgtagtgtggggagactgtcatgaggggtgatcgatataagcaggcgacggtacgtagccaggggggtacccggcgggtatcgcatttgggacaacaaggggcagcggtggtggggcgaccactacgagctctgccctgacgctctcctgacggagctgaacggcgctgccgaacccgcgaagctcaccgctctcctcaagcagtaccgagcacagaaacgctgacggagcgagcgaccggtttggagcatggtcgggtgggcgtggccgaactggcctcggacgacttgtttcactgcttgatcagtggcggcagcgtccagctcagcacttcgcctcttggacggccgactcgctcacctgatctccaggaagcacctcctcgaacaacgaggtgacgctccgcgatggctccccaagatctgtgccagaacccggaactcgcggacaaaggcggcgagtcggcgaccccgacctcgatctcgtcctgacaggcgatcacgttccagggggtggggtcggccggcttgacggcgcgggaccgcacgggccgccgccccgcgggggcggcggcccgggtttcccggcggccactcctgcgcggcccggccgggcatttcactcacgcgggcatcgcgcggaagagtgcgcggcgacatgcagtgcaggaaccctgttcagtcagctgtcgtcgtccgagggcggtgggtggtcctcgcggtcggcttcatccagctcgcgcatgcggcgctcgacgccttccttcaggctttccccctccgagggctcttcgtccgcctgggcgggacccgacgagccggggtcgggccggcggaacttccgacgcagtttgtccgcgcgatccttgcgctgccgagcgtcatcgctcacgactgctccctgacggcccgggacggccatgtgcggtatgggccaccctcacttccccgcccccttcgcctttcccttccccttccaggcctttgcggcggggttcgcggccttcaggctctcgatctggacacgccacgcttgggcccgggcgccggtggacttcttggcccgcgccgtgagtgccttcgcggtgccgtaagacttggaggccggaccgctggcggcgaggcggctgaccgttttggtcttggcgtcaatggccgcgcggaggctgctgctgcccgtcaatttccccaatctgcggaaggtcggttcgtcaccctcgaaccacgtctgttgccaccactcgtccgagaccggttcgcgccagctgatatacccgccgcgcagcacctgtctgggcttcttgatgtgaccaccgaagctgtagcgggcaccctcgacagggaccgggtcatagaatctcggcgtgaagaaatccgagacgagcatgccgttgatggtgtagccgaactcctcggcctccgaggggtcggagacctccaccaggaactccgccacgccctggtccgggtgcggagacttgccggccacgagacggttcccgaacgggtcggcgcacatctccagcatctcgtggctcgctgtcagcgaccagctcgcgccgaactcgatcagggagaacggctgtccgttttcatccgtgtggaacccggccgcgtcggggacgtcgtcgaccacgatcagcggccagtaccccacgggaacgtcctcaagtttatcgaaggcgtccacggttgcgttgacgtcccagatgggcccgaaatcgcgcgtcgcctgcttctgcagggcagcggccacccgggtgagctgcgaggggctgatctgattggttcgagtctctgacacgagggcgagctggacgatcaacatggacgtttgctgcctttccctgagacaacggcgactgccagacgccacgagcttcaccgagaggcatccagatcatgcgccggtgcgcccagaagtgtgcatatgccagtcgaacgatggacacccatccaccaggtgctgctgcgtgccgccctgcgaccccaggcggccgacacctctgacgcggcgctcttcggtacctgctcgaacgcaagcaggcgccgagttcctcgacggccggggcagcgtggtgaatgcccttcggggcgacccggctgtgcgccgcgatccggcctgaccatcgcggcgggggctctggtccgggttctatccgggcagtgcccggagcaggttctcgagatcgcgctcgccatggggggtctgggcgccgtgggccagtccgccacggatcacatgctcggctgcggggcgaacgatctggcccgcccaggcgtcgtgttctcgcaggagaccctcggccaggtcctccggggcgatggcgcgcttggccgccgcgatcacaccctcgggcagggcggtgatgttgcgggcgaggcggtcgacgaagctgtcgagttcgtcagcagggacggcccggttgatccagccgtagcgctccgcggtttcggcgtcgtacaggtcggcacccagcaccgcttccagtgcgcgattgcggccgatccggttggcgaggtattgggtgcctcctccgccggggacgatgcccatgagagcttcgatgtgaccgatcccggtgggtccgatcgccgcgaatgccatgtccgcggccgtgacgaactccgcccctcctccgcgcgccattcctgcaagtttgacgatggtcacctggggctgctgccggagcagctctcccagggcctggaagacgttgacgccgtcgggaaggtcggccgcgagctcgtcgaaggcgtctggcgcgtcgacgagcgacatgtcgacgtgggctatgaagaactccgggtcagcgctgtcgaacacgatcaagcgaaccgagtcgtcgtccttcagcgtggtcagcaagtgccggaggtcggccatcatggcgacgtccaggacgttgacgggcgggttgtcgagggtgacgcgggcggtgccgtcctcgtaactcacccgcagggtcgtgtaggcgtcgtcgttcatggacatctcccaccggtatctgttacgcatctaggttcctgatgcatactcagcgtgcgatcatgggggaccggcgtcaataacgcactttcggcatcgcaaggatcgcgaaggataccgacatggccacctccgagaccggcgtcggtgccggcatcgacaccgtctaccggtctgactgccccagccgcccgatcctcgaccagatcgctgacaagtggtcgatgatggtgatggccgtcctggacaagcccactcggttcaacgaaatcaagcgccgcctcgaaggcgtgacccaacgggtcttgacccagactctgcgccgcctggagcgcaacgggatggtcgtgcgccgcgtcctgccgacctcgccggtcggggtcgagtactccctcacacctctgggcgaatccctgcgggagccgttcggctatttgtacgactggacggtcgacaacgcggacgagattcgggcgcaccaaagggagtacgaccaacgcggtcagagctgagaaggtgcgtccgagaacgccgtcgtcctgagccgacttgctccgggcgccgcttcggcatccgagtccggcctcgggtgaaccccggcagcactcatggcgtttgctgccgagccgtggtcatctcggcccggacggtacgaggcagagctgaccccagcggtccggggccgcggcaccctcaccgggggttctgcatccggatcaccgccgaggtggtggagcatccgcacgctcgtcgcccacgctgtagcggccctgggaccgccggacgacgtgccggcagtgccgtgatcgcggtggtcgggcacatgccgatggctggagcgcagttgccgaccggaagcggaggtcagtacttcttcctgtcgtgcatcacccgtcagcgaggcgttggatggtggcactcagccaggcctggagctcggcggggtcgccgagttcggaacgcaggacccgccggcgggtcgagacgccgagcacgaaggcgtcgatcgccgcggctcggctgagggcgtccgcgtcgtccagtccgctgtcgcggaggtagcggtgcagcgggccgagcgagttcgtgtcgaggaaggcggccagtgcctccgccgcctgcgggcgttctccggaggcgcgttgcagtacgagcagtggatcctctccgggggcaccgaaccagcgctggacgatgttcgcagcgaggtgtgaacccagcgcggagagctcgccgtcgaacgagttcgagaccgggatcttcacctgggtcgccgccaggaaaagaccgtccttgccgccgaagtagcgcgtgatgaggttgggcgacacgccggccgcgtcggccacgcctttgaccgtgatcgccgcgtacccgtgctgggcgaacaggcgttgggcgtgctccaggatccgctgcctggtggcggccgcattgcgcgaattcatgtgtacgagcatacacatcatgtgtacggtcatacacatgagtgatgggatacgggaacgactccagcggacgcggcgggtcacgaccccgtggggtgacgacggggcgcgcggcatgagcggtacccgcctcgacgaactgctcgaacactgggcgaacggacacgaaccttgccccgcagcatgcgctcacggcggacccggcgaagctcgcgcccgacgcggcggcctacctcgaccggtcagtgcagtggttccggaccgagggcgggtacatcgcggagcagtcgacacggccgaatacgctcgccgtcgctttcggcgactcacccgccggcctcgcggcatggatcatcgagaagctggagtcctggtccgacgggtcggccttcactccggacgagcttctcacctgggtcaccgcctactgggtcaccggaacgatcggcacctcctttaccacctatgtcgaaccggccgccctccctgaccggatcgacacgccgaccgtgctctccgtgttcccgcgcgacatcaaaccggagccgcgaagctacgccgaggcgttcctgaacgtgcgcgactatgtggaacaccaggtcggcggccacttcgcagcctgggaacagcccgaggcctacgccggcgacgtacaccgtgcggtcaagctgggcggcgaaacggggcttgcggatggcttctgaacgcttccgtgagccgcacccggcagcgccgcaccgggcgcgccccaggtggcgttctgtcggcggacggccggtgtcgcgcagcgtggccaccgtgcgccttccggtgcgggccgcggcgacggccgcggccggcccggtgccggaggtgccggtcatcaggacggtgcggagggaggcgtcgtgccccggaggccctcggcacggtctggcacgaactcgcggccgccgcccaaggccgctttccgggccgccttcctcggggtgtggacctctgcgaggcacccggtacggcgttacggttttaagggaggccgtccaggtgaggaggccgaacatgctggtggacacgctggctgccctcgcaatggcgggcggtaccgccgtggtgcaggctgccggcaccgaggcgtgggccgggttcaggcaggcgattgcgcactggttcgggcgtggtgacgccgcccgggagcgggcagagctggagcggctggatcagaccgcaacggcgctgcggacggcggacccggcccaggccgagcgtgcgcgcatcagccaggaagcctcctggcaggcccgtatcgaggccgtgctggagaacctggacgagggagaacgcggtgaggcggccgacgggctgcgcgccctgctgaccgatcacactccggaggtccgggtgacggcagcgtcgggcgggctggctgccggcggcaacgtggacatccgtgccgagcacggttcgatcgcagccggtgtcatcgacgggggtgcgtatgtcggcccccctccgacgccggatccgcccgaggagtaggcggatcggagagctccggccggctctcccacccggcgtcgaactccctttgcccaccagggggcatcgcggccagcgaccacagtcttgctgtcggccgggccggcaaggtcgagttccacgcggcaccgcgtccccctgtcagctggccgcaccaggtcggcgtcctgcccagggaagcagagtgcttccaggaccgtgccaccgccggaaaactgagcgcggggtcggcgggcgggtgcgggaccggcggagccgggttgccctaccaggtgttggtcggcctcggtggagtcggtaagacccagctcgctgcccaccatgcccgcactctctggcagacggctcggctggacctgctggtatgggtcacggcagccacccgcgacgcggtcgtcaccggctacgcgcaggccgcggccgagatcctcggcgcggaccccgccagcccggagtccgccgcctgctcgttcctggcctggctggagcccaagcccaccgcggcgcgccgttggctggtcgtgttggacgaccttgcagatcccgccgacctgcggaacctgtggccccccgccagccctcacggtcgcaccctgatcaccacccgccgccgcgacgccgcgctgatcgggcacgaccgacgcctggtaccgatgggtctgttcacagaggacgaggctgtcgcctacctcaccacggcccttgccgcgcacgaccgccacgagcccgccgacgaactcctcggcctcgccgacgacctcggccacctgcccctggcgctgtcccaagcagtcgcctacctcaccgacgtcgacgtggactgtgccacctatcgacaccggctgtccgaccgcgcccgcaccctttccgacgccctgcccgacccgtccgggctgcccgacgaccaggccaccaccgtcgccgccgcttggtccctgtccatcgagtgcgccgaccgcctcccaccggcccggctcgcccggcccatgctgcagctcgcctcgatgctcgaccccaacggcatccccggcgccgtcctgaccagccccccggccctgggccacctcgcccggtaccggggtgccgtcccggggcggacggacgccgcagaggttacggtctgggacgcgacccaggctttgcgtgcgctgcaccgcctcagcctgatcgaccacgcgcccgacagtccgcaccacacggtccgcgtgcaccagctcctccaacgtgccatccgcgacctcctgcccgcggagcagcacgaccggctcgcacgaaccgccgccgacgccctcatggccacctggcccgacatagaacgcgacaccaccctcgtccaggccctgcgcgccggcaccgaggcgctcaccctccactccgaggacgccctctaccggcccgatgcccaccccgttctcctccgcaacggtttgagcctcggcgaggccggccaggtcgccgccgcgcttgaccacattcgccgcgtggccgatgccgcccgggagaagctgggccccgaccatctcgacgccctcaccgcccggagccacctcgggtcgtggcagggggcggccggggacgcggcggaggccgccacggcattcgaggagctgcacaaagatctggagcgcgcagtagggcccgaccaccccggcaccctggtggctcggggcaaactcgcctactggcggggggaggccggtgacacggcgggcgccgcgacggcgttcgaggaactgctcgcggaccggcttcgggtgctcggacctgacgaccccgacaccctgatcaccaggggcaacctcgccttcttgcggggggagacgggggacgctgcgggagcggccacggcgttcgaggagctgctcgcggaccggcttcgggtgctgggacccgatcaccccgacaccctctgcacccgtggcaacctcgcctcctggcgaggggaggcaggggatgcggcgggggccgccaccgccttcgaggagctgctgacggatctggagcgcgtactggggcccgatcacgccgacaccctctgtacccggagcaacatcgcctcgtggcgaggtgaggcgggtgacaccacgggagcggccaccgcgttcgaggagctgctgacggacctggagcgcgtactggggcccgaccaccccgcagcgctctccacccggggcaacctcgcgtactggcaggggagggcgggcgatcgggaagcttcctcccgggccttcaaagacctgctcgcggatctggaacgcgtactggggcccgatcatcccgacgctctcggcacgcgggacgacatcgcttactggcgggggcggcgaccgtggcggctgatcaccaacaggatcaggtccgtggcacgcgacgactgacgggtatgccgccgccgtcgccgtccgacggtgcggaggtgcggatgcgggcggctcgccgcagctcgacgccgccggctcgccaggcggtggggggcgcccagtggggatgggtgcacagggtccccgagagggtgatcagccggcgccgcagcgcggtcgtcccggccccggcgggggcttgggcgaggtcggcgtaggtctgctgccacgcccgttggagcgtgatcaggtcctcggggaactcggggaagcggaacggtggtctcacaccccaagtgaaacatgtgttcgattatttctgcgagcgagcgacgcaccggttgcggcgggtgtgactgagcgcgctaggttctgtctctttggtcagcgtcgggtccagatgaggatgccggcgaggtggagtgcggcctggtaggcgatggcgagcttgtcggttcgtgtggccaggccgcgccactgcttgagccggttgatgcagcgttcgaccgtgttccgctgcttgtagacctctcggtcaaagccaggcgggcggccgcctcggtggcctcgccgcaggcggtggccgatctggtcggacggctgcgggatgaccgcgcggatgccccggcgtcgcaggtggctgcggatggctcgggaggagtaggcccggtcggccagaacgacgaaggggcgggtccgcggcctgcccgtgcctgtgcggggcacccggatgcgggccatcaccgtctcgaaggcgggtgcgtcaccggcctggcctgcggtgacggtgaatgccagcggccgtgccccaccgtccgcggccaggtgaaccttggtgctcagcccgccgcgtgagcgtccgagcgcgtgatcggagggctcgccggagcgggccgcccccttttgcgtgcgccggccgcgtgctggtgggcccggacgaccgtggagtccactgacacggtccagtcgatgtcgtcgtcggcgtccgccgctgccaggacggaggcgaggattttctcccaggtgccgtcgacggcccatctgagcagtcgtttgtgagcggtctggaacgacccgagctcgtcgggcaggtcccgccagggcgagctcgtgcggtacttccaagcgatggcctcaacggtgcggcggtggtcggcccaccgccggccgcggaccggatcggccggcatcagcggctcgatccggccccacatcgcatcagtgatcactaatcggacagacacatccgatcaactgaccaacccatcaaagagacacgctctaggcgcgtccgcactcggccacgcgtcgtcaaacgcgccatctcaagtacaacgccaaaggcaccgtcgacaggaacagttacaaggccagcatcagcatcgacatcctgaccacccgcacgccttgacgccggacaccaaacgctggctacacggcattgagcctagaagaggagaccgacgaggccccatcgccgggtgccggcctccgtggccacgtcgccccattcgcgcaacagggctgcggcggcgtcgaagccggtgggccggcccgcccagccagcggcttcggcgtcgaagggcctgcgaagttcctccagccggggcgcggccacctgccaggagcggaccagctccgacacctcgtcgggggcgctgagcaggagcacccgggggcgccacggagcggggtcgtcggggaagccgggcgcggcgggccgttcctcctcctcgacggccgtggggtccttcctcgtgaggtcgtccgggtcatcccagaacaggccgcgcaggaagtggtccagggcgtcacgcagttcaggcgccgccagggtccggatgtcttcccaggcattgcccaatcgggggtgccagctgtaggaaccggtggttccgtggaaccggtactcggcgcaccaggacacctgccgctgccacacccagccgcccgtcacggcgtagtcggcgtcctcgcacgcctcgcagcagaagccggggcagacggcatcgctcagtacgttcaccctgtcgtccgccggtatccgcgccaggtgctcccagtcgaccatgagcacggtgatgtcgagtcccatcggggcaggctagtacccatgcagtgtggttagggccgggggcggtgtgtcaagcaggctgagggagggatggggctcctgccgaatccgtgtcgacctcctgggccgcgggtcacaaagggtgcgctccgcgcgagcggaggtggtccggtgtccacccgggtaccaagccaggtgcggcggtgctctccgcgggagcggaggcggtccaaagcacgtggtcaggactcctctggcggaggtggtggtggatattccttcggtggatgcggtggcgcggcggtagttggtgtcagaggggccgctagattacgtgcggcagcgccacgcccggtggcccggcggtaggttgacgtggaaggacgccatggaattcctacgcgagggcggccactggccgctgttggtttctgtcgggctcctcgccatatccgtctctgtcgcacttgcagtgcggacctacagccgatggcggctcgtccgcaagacgttcaacgaagggctacccgccgagggcagggtgctcgatgcatacgtgcttccaggagaccagggtcggccaggcctacagcacgccatcgtgggcttccgcgcggccgacgggcgcgagtaccggctcgacatggacaccggccggcgagagcccctgggcatgcagatgcgactgcgctatctgccatcgagcccggaacgagcactcctcgtcgaagcgggccggggcaccgtgcgcacggtgctgaccctcctgtttctggtatgcctcgggctggtcggcatcctcctcacggtgctgggcctgctctagtcaatggcgagcgcggactcgacgatctgcggggccaccaatacgctgcggtagcccttcttggggacccgacggtaccgggcagacgagcccggccagcccaccaccgggacgatgaaggtgttggccgatccctcggtggcctgaacataaagatccgcttactgatcgtttcagaatgggtcgagctgcgggtcttgcgcccggcgatcttggtcgcaagggtgtccggaggcgttctgatcttgttctggagggcctgtgggagggtggctccgctgctgccacccgctcccgaacggcgacgtcggcatttcgggcggcctcgcgttccggaccgggcggctctcgcctgcgtcttgtacgtcctgcggaccggcgtggcgttgcctggcgcgatgtcccgggcgagaccgtgggctgcttggcgtgacaacctggcgtcggctgcgggactggaccgaggctggtgtctggccgcgtttgcacgccgccctgctgaccgagctacgccgcgcggactcgttggacctgggcgactgagccgtggacggctcgcatgtccgggctctcaaaggtgggatcacgtcggcccctcgcccgtcgaccgcgcccgccccggctccaagcaccatctgattgtcggccgtcagggaatcccgctcgccgtcgcgctcaccggtggcaaccggtcacgacgtcacacaactcttgccgctgctggacgcgatcccatcgatccgggggctgcgagggcggccccgccgcaagccccggcgtctgtacgccgaccgtggctacgatttcggcaagtaccgccgtctgctgtggaagcgcggaatcaagccgatgatcgctcgacgcggtggcgcccacggttctgggctcggcaaggtgcgctgggtcgtcgagcgcaccttcgcctggcttcaccacgtcaagcgcctgcgaatccgctacgggcgccgggccgacatccatcttggcctgctccaactcgtgtggagcatcatctgtctgcgtcggctccgcacctcaggatgaagaaggagccgggacgacaggctccgacggccagtcgagaacagtcagctcaggccactgttgttgccagcgatcggccttggcctcgtacacctcgcgcggggcaagaaccgggttggggcgcacgacgaggttgaacacatcggagagcccgtgcggcgcatagacgcgccacctgctgcctggctccaggcgcacgcccaggcagcaggtggtcgccgcgaagctgtcgatggccgcttccgtggaggcatgaggagcgcacgcgacgccgaacttctgctcgtaccagaggtggacgcgagcctcgtttcggacctcgacctccgccggcagccctgcgaacgcttcgccgacggccttgattaccgtgtcctccgcttcccatgacaagtcacggtcgtcaaagtagaagacgtcgtagtccttgatcccgctggtgggatgcctgtctgtgaccacgttccagacggtctggaacaggcaacccgccgtcacgtaccagttgggcagccccagttctgccgtgcggttcagcacctccaccagcacctcattgcgggccagcgcagacttcagggcggcaagctgctcgtcgagcgggaggcgaccaatcattgcctatgcctaccacgtgactggcctacagcgcccgcagccccctactgcgaagccctcacggaggatccgattctgaaacgatcagtaggtgctttccgggagggaggaccagggtggctcaatgcgttgtcggccggccttgactgggggaggagagggtagtggcgccagacgcaacggtcgcgaagcacgggggcgtgaccgtggagttccaggcggttcgtggggtccgttgaacgcgcccctgagctgggagggtcaccgagtgtcgtgcagtctcccatgaccaggcaaacgttgtccgatgcggcactagaacagcgatgccggcgtcgcaccgaaatcatccagtgtgagcggggagcactcctcgagactttcctgcttcacggcgtgctttgcgtcggtggagagcacatcagcggccgaggtggtcagatgcggcggggttcgacgatcgcctggggggatgcggagcgcacgacgctggctgcggggacgacgctgctgcccatgcagacgctcgcggcgatggccgagtgtcggcccacggcgatgccggggccgagggtgatcatgctgccggtctggacgtggtctccgatgaggcctccgaattgggatgttgtgcaccggtagggcggttcgccgccggggccgtgaaggacgatctccttgacgggaacgcgcatgtcgtagttccacaggctgatcgccgcgatcacgaggtttgcggacaggtgggcatcggccccgatgacggagtgcccgatgccgacctggtggccgagaacggtgttctccccgacgaaggagtgggtgacttcgcagccgaagccgacggacactccggcggcgaggacggagcgcttgcggacggtcgagaactcgtggacgcggaccccgggcccgatgatgacatcctcgccgatgatcgcggtggggtggatccgtgcggtggggtggatcctctcgggcaggacctgtagggcgtcgtcgtgcaggacgtcccagcgggtaaggaagtcggatagctcgaactcaccgatcttggcgtagccggtggcctccagacctgacgccgcggggctgtggacgtagtcaccgatacggatggaatcgggcacctgactctcctggtcgtcgtcggggtagtgggagtggtcaggccgctgcggcggcctctcggcgcaggaagtcgggcagggcggcgggggttgctgtcgagccaggcggcgtagcgggccacgccttcgggcaccgtgatgcagggttcccagtccagggcggcggtcgtgcgggcggtgtcggcggtcccgccgagcgggtcgcctgcgggaagcggccggtcctggaactcggcgtcggggtagtggttgcggatgaggtgggcgacgtcggcgatggaggtggcctcgccggtgccgatgttgagggtttgccggtttgcgccgcgggcgagcatggcctggatggtggcgtcggcgatgtcttcgacgtggacgaagtcgcggacctgtcggccgccgccgttcaggtgcaggggtaagccgagtttggctcgcatcgccatccaggcgaccacccaggagtgcgatccctccttgacggtctggggttcgccgtagacggagaagtagcggaccgaggtgtgagagacgttggcctcgcccagcacgagcgcggtctgggcctcgccccacgccttcgtgttcgcgtacaccgacagcggggccacgggcaggtcctcgtgccaggtctgcacgtcgtggcgctcggggtcgccgttgccgtagacggctgccgaggagacgaacacgaaccggcgtacgcgggcgttgcagcggcgggaccgtgtccaggaggacctgggtgccggtgacgttggtggcgagcgcggccatcgggttgcgggtgcaggcggccacgtcggcgacggcggcggcatggatcacgtagtccgcttccctcacgacgtggtccatgagcatggggtcggcgatgtcgcccacgatggtgtcggggtcagtggtgtggacgccgaacaggtcggcatagacggtggcgggataggcgtcgagcttgcccacggcgagcacgcgggccccggccgcgcgaagccgggcggtgatgcgggagccgaccaggcccccgcctccggtgaccaacacggtcgaaccagtgagggcagcggacaggtcggcgtcagtcaggctcacggtggtcctcggattcgagcgggaggacaaggtggtggggagggtacgaccgggcggcttgggaccgcctccccggcaggtgccgcccggggcaggggtgggctccatcggacggaccggcggtgcagccccgggcggcgtgatgaacagtcaactcggccacacgaaatgtgagtaccgtgggcgaagcagcaacccgttcaacccgttcaagatcgtttccggaggggtcgatgttggcaggggaccggacaccgaacagcgcgttagccgacgtgatcgcctagtccggggccacgtactacgcgctggccagggagatccgctctgtagcagccgaggccggccatcgattgagtaccgggccgtcggccgtcgcgtactgggtcgccgggggtacaccttccggccagacgccgtactacatcgccgaagccttgacgagacggaccaagcggcgggtgacggtcgccgagatcggtctaggctgcgaaggcggcggggccatggaaaccgatccactggccgccatcgccgatctcgggctctgctgccgtcggtctgccgctgacctacaaccacgaagcggtcgccgcgacgctctgggcggccgagaccggcgcaagcgtcggcccgaccgaagtcacgacggtacggcagctcaccgagacgttccgcagcgcggacgaacgactgggcggtggccacggcctgaccaccgtcaccgcctatctgaccgacaccgtcgcaccgatgctcaccgcccggttcccctccgccacggtccggtccgaggcgttcggggcggcggcccagctggcctgcctggtcggctggaagcaccacgacctcgggcgggagggcgccgcccagcgctactacctgctgggctaccaactcgcctgcgaggccgacccgaacggccacgccgcgtggatgatgcgggccctgacccatcaagcccttgacctgggccaccccggctcatgtcccgagctcgccgaagcggctctgggcagggctgtggggaaggtcgaccgacagaccgaggccctgcttttggtgacgtgcgccagggcgtacggggccggcggacagagcgccagggccgcacgggcccttctggccgccgaggacgccgtgacagacacccgcgacccggtcaccgcctacgccgccgcctcggggccggtggcggccacggtcgcctcgcacatgggcaagaccctgaccgcgatgaaggaccacatcgcggccgaacggcactaccggcgatccctggcaggccgaagcccgggcacctaccagctcaagcacgggctgaccatggccaacctggggcgatcggtggccggtcagtaccggcacgaggaagccgtgggtctgtgggcccggtccctggacttcatgggcggtgtggtttccgaccgcaaccggcaggcggtcagggagatccaggcggcggcggcccggtaccgcaagcgcggtgtggtcggcgcggcgagcctgaaccagcgcgccaccgaactgctcaacgaccaggcgtgaaaggaacgaacaccagaatgccgaagatcggggttgtggtcctgaccatgggcgaccggcccgccgaactgggagccctgctggcctcggtgaccgcgcaggaaggcgatccggcaaccgtcgtggtcctcggccagggcgtgaagctcccgcccctcccggacgccgtggacggcgtggagctgccgcagaacctggggatccccggcggccggaacgccggcgtggcctggctccgcgagcgcggcggcgtcgacgtcgtcgtggtcctggacgacgacggcctgttgccccgcaccgacaccttccgcctggtccgggaagcgttcgccagcaggccccgcctggggatcgcgggcttccggatcgcggacgagaccggggagagtcagcgcaggcacgtcccccgtctgggcggcaagaacccgatggtgtccgggccggtgaccacgttcctcggcggcggccacgccatccgcatgaccgtgatcgaccaggtgggcgacttccccaccccgttcttctacgcccacgaggagaccgacttcgcctggcgggcgctagacgccggctgggagatcgactaccgggcggacatggtgctccagcacccccgcaccgaggcgtcccggcacgcggtctactaccgcaacaccggccggaaccgggtctggctggccaagcggcacctgcccgccgtcctggtcccggtctacctctcaacctgggccgcctacacgatcgcgcagcgacccccgctgtccggtctggcagcctggtgggccggcttcttcgaaggcgtacgggtgccgtgcccgccaaggcagcccatgcggtggcggaccgtggggcggatgaccaggctgggccgacccccggtcatctgacgccgcgcgccccactgctcgtgcaccgcacggatcgccacggcctgccccctccagctcgccccggcagcagggtgccggacccgccgccatcggagtagagggcacgggccccgggggcgcggtagggccagggcatcgcggccgccaccgctgcggccgtcgtgcggtcatgcgtgccctgcggaccctacggtcggggggttcaacgcgtcgcaccgtctgcacaacctgctggagcagaccgcagcagaggttggctccggcgccgcggtatcgagaggaccgacgtcgtcgttcccaacggcctgctgaccccggacccggccgtcatcaacgtgagggcttccgaggtcgggcgtcgccctttcagcccgccacgcccgttcccctccgtggtgcgaggcgctgttccgccgactgtgcaaacgacactgacttcggcgaggctcttaatctcctgtttgggagaacccgcttctggtggggccgctgcggatagggtcggggcagctcgtgccggcatgggtgtacgggtcaggcccggtgcccagagcgctctgggggcagtaccaccgggctgtcccgccccgcaccggctatcgagctgctcacgcagctggtcggccggagcacgagggccgcaccttcctgaccagaaacccgtggctctggtccctgagtctgagtggcgcgacgtggatctggtcgaccgagagccgggcctcctccaagtgtgccgtctgggccgacttgcagccgccgtcccgggggatcggtcgctactcgaggacgacccgcctgcgtccgcggggagtctcgctcggtgcgatgtcgctgagcgcgcgaggggcggctgggcatgcttcggcgtacagcatctggatgtcggcgatgagttcggtgtggtcgtcgagggcgatctggcttgggtcggcggcgtatctgatcaggccgaagaggctgcgggcttctgcacgggggctacgcgctcccgattcccatccgcaggccaggggccgggctgctcgggggtggcccggtcacacggacgcgtcggatgcgcggtcgagaaaagaattgatcgtgggcgtgtccacatccgcatacgagtgagtgatgggagacgtacgaccggtgcggtgagtggccgacacaagatcactggggtgttctggtggtgcctcgggcacccggaaggggtggctgcggctcaccgcccctggcccccggacttgccgtcacgccgccagcccggggcgaggagagcggacccaggcgaagcgactcctatgcccaccagaactggcgccgatccgccctgcacgcccggatccccccactgccatccccagaacatgggcgtagccaggctgtcgtcgagctaccggttggcgcagtccaccctgcagggtgatgccgcctgtggtggcatcacgccatgaaagatcccttctcctcctcggaggtaccgactctgctggccccggtggggtgcgtggaccgggacgccgcgcgccgcgcggtcgccgaccgtgccatggatcgtgccgacctcgcgcagctactcgacttgctaggcctgtggccgcgcgatgatccgcccgcaccaggcacggccggcacgccagcggattccgggctgggcaagaaccggccggactgaccaccgctgctttccacactgcgtcgtacgctttgcgtgatctgaccgaaggtgcggggcgcagacgtggtcgtgagcgggcagaatcgacctggcatgaactcaccaacatcctcagcctccacgcagacccgcactgccggcagggatcgcaagcagccgctgcggtctcgggtcaggcacggcagccccacctgcgccgactacggctgcccgcggtcgcagtgcagggccgcagcccggcgagaccgggcccggcgcaccagcgaactcatggcgggccgccccgcccgtgtcccgtcatccgatgctgccgcggcggcacgccgcctgcagagcacgggcctgtcggcagcggacatcgccgagatatccggcgtcgccgtcaccctcgtccggcgcttgctgcgcccagccgcagcacggccgacccgtatccaccgcaccaccgcagaagccatcctcggcatcccgctgcacaccgtccgccgacgcgaacggccgctccccggcctcgtcgaagcggacagggccgctacccaactgcagggtctcgcagagcacggctggcccacgaggttcctcgccgaccaactgcgcaccagcacgcaaaccctcgcagccatacgaaaccggaaacgccggcgcctcgccctcgtcctggaccgcaagatccagcgcctcgccacgctgctgctcgccagcgatccagccgaccacggcatcgccgcccaccggagccgccgcgcacagaccgccgcccgccaccgagccccgttggtgacccacggatgagaaccttgatgacctcgatgcacagctggccgtgctccggcagccccgagacagaaacgccgacgaccaagtctggcactgtcgaagggggtcacgactgaactggccggcaccgccgcgactgtctggactgcgctcgattcgcccacttccggctgcgaagtggagggccaccgggatggtgccgacggagacgacgcgctgccgccccggggcccttggcgcacgggagtctcccgaacatccgcccctgccgaatccggccagtacagcgcattgccgccaatccccgacgatctggtcgcagcgctgctgacctccagctacacaagacagacgggggctgtcgcccgctgcccctgacaggtcggacgggggactggaggctttgctcacgatcaacgtggcggtactcctggcagtcatcgtcgtcctgcggctgcgccgccgcacagaagcccggagccggttcgacgagaagatgaccgtcgccatcgtcctggctctgggcatcatccttgcccccacagagatcggccagggcatcgccggcttcctcggctagctggtcagcggcacctcccaggccgaccagtgaccggcgaaccacatcggcagacgtcctgcgcgcattcggatgcattcctcgggcgcggcaggtgagcggccgccgaccggcccggcgctccggccgccgacccggcaggccccggcgacgcaacaagcagcgccaggagcaggtggtcctcgccgcgctcgccgccctagtcgtgctgagcctggtggtcgccgccctgcggtggctggccggacacccctggattgtggccgccctcatgctggtggccgccgtgggagccggcgcctgggcgtggcggcgcagggaggccgcccggtgggagcaggttcgggcgagcggtctgcgctacgccctcggacagcttgacgtacttcatcaccgtgatttcgagtttgcggtgcgggacctgatgcgtcgcgacggctgcacggatgcgcgacaggtcggtggccgcggtgacaacggcgccgacgtcaaagccaccgacccctatggccggcgttggtctgttaactgcactcggttgggtcgttgagcgggacaacgacaaacccgccaaggagccccattgcccaaggacctgcgacgcgaactgatcgagggacgtcacgacgtgccccgtatcggtttggtggtccacctgcttcgcaagttcccgccgtacgccgtggtcgatgctgccggcgtcctggtcgccccagccgagtcgtacctcaaggatctcgccctcggtgacaacagcccggccacctgccgcagctacgcctacgatctgctgcgttggttccggctgctgtggctgctggacgtcgactgggaggaggccaccgaggcggacgccgccgccatggtcggctggctccggacggcgaagaacccgcagcgtcaccgcagcaatccgtccgccccaccgcccgggtcggtgaacacccgcaccggcaagcagtacctgaaggctggatacgccccgagcacgatcaaggcttctacgccttccaccggcactacggccgcggcccggtggccaacccggttccggaatcggtgcagcgccgacgggccctggcccatcgaagcccggacgaaccgacgccgttgcaccgccggggccgactgcggcagcggacctcacagaagcagccgcgggcgatccccgacacgatgtgggacgagctgttcgcggccatgaaccacgaccgtgaccgagccctgctccagctctacgtctccagcggagcccgcgccagcgaactgctcggaatcaccatgggcgacatcgactggtccggccagcaactgcacgtcatcaccaagggcaccaatcttcgcgagccggtccccgccagcccacagggcttcctgctgctggccgcctacctcgacgaggctggcgttcccgccgccgatgagccggtgtggcggactcgtcacggcgccgagaggcccctgacctactgggcgatgcgtcgcaccctccagagggcgaacgcccagctcggtaccaactggaccctccacgacctccggcacaccgctgctcagcggatggccaacgacccccacctgactctctcggaagtacgcgcgatcatgcgacacaccgccttggccacgacaggcatctacctaacgacccgcgtcgaggatctcttcgacaagctccaagagcactacaaccggccgcgcgtcgagcggtccttcgctccgggctacgaccccgctgacgtccgggcggtgttcggtggctaacgtccagggcacccttgcctcgacctacaccgcccgcaatcgccggactctgtttcggggcatggacttcgacgagccggtcgccacccgcttcccggatgccgcggttaaggccgcaccggcccctcggccggacagcccgccagcacccttcggcgatctgacccaggcctcgatccagcatctgtgctcgctggtcgagcagatcgtgccgggtcgcacccactccacctacgagaagcgccgccgcggcctgcggctgctgttcactcatctggaaaccctgcccggagctgactggcaggcgaagtgggaggccagcccgtttgacggtgacaaggccctgccggtcaagaccttcgtcatctccgaccgggcccaggaccgacatgacgtgaccccggcggcaaagttggcgttctgcgcgcgggtgatccagccctcggtcggtggattccgcgcgaacgccttcagcgactatcccgagtggttcgggccggccagccacgatcctgccctggacgtgttttatgcagccgtcgacgcccgccctgacctggggttgagttaccgcatccgtatcaagttcgacgtcgcttgcgcgctcaccacccagggcatcgccttggagcacctcactccagaggccctgctgcactactcgctggagtgccgacgtctgggtgtcacacacggggccaggggtgatcagtcgcgcttcgcggctctgggcgcctgggagatcctgcattcgatcggacactttccgcccggcaccccctccacgctgcggaagttcatctacaccgggcagctcacccccgagcagatggtcgaccgctacccgctccgcagccaggccgtccggcaggtgattaccgactacctcgtccgccggcaggctgataccgactacatcacccgggacggcctggcccgtctgctagcagggaccttctggtcgaagatcgagaagatctgccccggacaggccgacctcaccctccccaggatctgaaggggttctccaagcgtcgtcgcgagattaaccggcgcatggccgaccgcacccggcaacggcagccgttgctgcctgacctggtgaaatacgttgaagaacggcacgaacgactcctggggctgctcgaagccgggcggcaggtcagtctgggcgagcccttcgagtacgacggccgtcgttaccgccgcagcaactcgaagaaggaccaggggctggtcaaggtcgaggccgaaccccccgtccgcgtccatgacgcagaaaccagtgagctgatcaacatcaccctcgctgaggactcggcgttctgggagtgggccgcggttgaggtcctgcggcacagcggcatccgaatcgaagagctgtcagaactcacccacctcagcattcgccaatacgagcgaccaaatggcgagatcatcgccttgctagtgatcgccccgtcgaagaacgaccgcgaacgagtcatccccatgtcagccgacctcttccacgtcgtggcccagatcatccgccgccacacccgcgacggccggacgatcccgctggtcagccgctatgacgggcacgagaagagctggtcagaccgcatgcccttcctcttccagcgacaggtcggcaccatccgcagcgtcctggcgaccggcaccatgctcaacatgctccgccggacctgccaagagatcggcgagacgaacaaagccttcgccggactgaccttcaccccgcacgacttccgacggctcttcgccaccgagatcgtcaacggcggactgcccatccacatcggtgctgcgttgctcggccatctcaatctccagaccactcagggatacgtcgcggtcttcaacgaggacgtcgtcgctcactaccagcacttcctgaacaaccgccggtccctgcggccggccatcgaatacggcgaggtcaccaagcaggagtgggctgagttcgaggagcacttcgagaaacgcaaggtcgagctgggtaactgcgctcgcccttacggcaccccatgccaacacgagcacgcctgcttctctgaactagcgatcgctactcgaggctctgtgtaaattgctggcagctgggacctcgccgggcaaagatgcagccatgcgctatgccaacaccgaccccgagctgatggacctggtccgacgattcgtcacgcccggccggcggtacctgcggctgggtggaagcttgttgcggttgagcgggcctgagcgcgagttgttcgtgagggagctggtccaggctgccggggagatcactcccgctgaactcggcatccttttcgagggcgggtggcgagagcgcaggactgcctcctggctggttgccgtggctggcaggaccgagttccgcagccgcatcggcgaactcctgctggccagcggaggcccctacggcgggtcatactgcatcactcttgccactttcggcaccagcgcggacgccgatctggtctgcagttaccttgatcgctacttgcctcaacccgacctcgtctgggaccagacctttgctctcagcacactgcttcacctcgatgccgtcctcgggaccgagcgagcatcccgataccttgccgccggtggcctgtggcagcagtggaccgatgccacgtcgaacatggtgcgggatccgcaggagtaccggcaggtcgtggaccggctctgttccttcgccagcgagtgcgctgaactcttcgccagaatggaaaccaggcgctgatcttcccggcctgaccgctggacgccgactgcttcggacccctcggtagactctgggcaatgacacgaaaccagggccgctggccaaagatcgaccaggatggtggcatcgaggacgtgacgctgctcatcctggaatggctgggcgagcagggcgtgaatgccatgatcagggtgggcgcggagcgggtggctgataacgcgccagcgtggacgttcgccgccagcggaggtcccctggagcacggcatgcgcactgatgggagcaccgtgcagcagtgcatgtccgccgccctggcccggctgcgcgaagccgggttgtctgttccgttttgatctccggtcgccacttgcttcgatcacggcgttgctcttgtggcctctgtggtgcctgcctgctggcggacgcccggcataccgagttcgacagcgatcgactgtctcttgacgagtgcgtcgacctgggcgagcttgtcctcggcgccggcaaggctgaccttgagtccttcgacctcgccgagccagccttcgcgttcggcttcggcgatgcgggcgatgagattgtcgcggatctcctcgatgcgggagcgttggtccgggcccggcctgaggagtgcacatctgacacaagcgtgctcatgaacacacggggtggaaaatgcacggccgcaggtgccgatggacaccttgcgcttctcgaagtgcgcgaggaaggcatcccactcctcctcggtgggagttcggtattcctcgctgggccgggtggaccggcggcgggcgatgaacgccctgtgcgcctcgatcgtctcggccgggtagacggccttgtagcccatccttgtatcgatgttcttgtgcccgcagatcacttgggcgatgtgtggtgggaggccgttcatgatggcgtcagtgacgaagatcctcctgaagtcgtgcggggagatcgtgagcggtgcgccagcggagtcgatgagcccggtggccgcgatcgcgccaatcagcagcgtgcgcaggaacgtgggagtgaaggcccgttgctcggttccgatctgccgctggaacagcagcggcatcggcgggttccagaccttctcacggacgtcgtagaacggcgccagcgggatcgctccagctggaccgcgtagtcggcggacgatggctgacaggacgtccgccaattccgggctgaccagcaggaggcgctcggtgtcggtcttggacggggcgatctggagcaacggaacgatctcgccggtggtcgggagccggtactgggtgacgctgtggtgggtcaactccaagagctcttcgttgcggatgcccgtcaggcggaggacctcgacggcggcgaacgcccagaacgcttcctcctcctcgaaggagaggttccggcgtcggccggtggcagtctcctcggcccaggtgaggtgtcccgcggccttggacgtgacggctcggcgaagcgatccctcggtgccggggatcaccgtccctggctcggtggcctgcgcagtccggagcaactcgaaggccgcgagcctgcggcggttggcggtgctgaccagcacggggagcacgggaaggcgctcgcgggtgcgctgatccatccgtgccttgcggtgcttgcgctccttggccttgcggatctcgtcatcgctgatcgggcagcgtacgacccacggtccccagcgggccggttcctccgttgcccagtgggcgaggtctagatagaaggctcggacccgcatcagctcgtccttggcgttgagccggggctggcgatctcgaccgtcgccccgtcggggccggtgatggtacgccgcttggtgctcaggtcttccttccaggtccgcgccagcaccggcggcagcaaaagagtgtcgatgcccggtgacagcgcttcgatccgcgtccagaacagccccgccaacgatcgtgagatcgcgtccaagctggcgaagtccaatgacggctgccgttcgcgaaggtagtccacgagcagatcccggatcgggcggcaccggatcgggtagcggtccacaagctcctcgatgctcagctggccgagagcctggccgaacgcccggatcgttgccggggcatcgtcagggaagacgcccatggtccgaagccgcaggtagaagtcgaccttgtgctgtccgccgcggacatggacccggcgttgggtgtcgaacagctccacgcagtccccaaccgtgatgtcctggatgagcccgcctttgcaggccaggaggacggcgatccgggtcgctgcgatctgggcgtctttactggagtgcgattgcgcggcggccatctgcaccaagtgctcgaacccgtccgggtcacggacctcggccatgatggtggccaggtatcggtgggtgcgggtgagcatccagggcaggctgggacggatcacatcaccggcgatcagcagcagcaacccggtggacaggtcagcgcggacgtacgacgacggcgaccctgcctgctggctcaggaaacgcagagggagctctgtccagtccgcgccgggaagatcctcgacgccgctgcgtgcccacctctcttgccaggtatctccagggaggcttgagagccagtccaacatcttcgcaaccccgcgccgacggcctgctctggtcgccttggccgcttgcaggaacggtggcgcggtcagccgccgcacaacctcctcgactgatcggctggtcgccggccagcggacttcggcggctcgcggcgggaatcgttcccgaagcacgctgttccgcgctcgtgcctgctcagcggtcgcgttcgcggcttgcagcggtgggcgagtcgagtgcttcttggtgatagtcatgatgaccgcccgaacaggacgtccagggtctcggggtcgtaacccggggccggaggcgggggcaccggctcggtgcgctggtccgcccgccgcgcgtggtgggccagcacctgggcgacgacctcgtcctggcgcgggttgaggtagatctcggtcgtggtcagatgcgcgtgcccgaggacccactgcacgtcggtcagcgtcagcgccgggtcgcgcaccatgcggacggcggcgctgtgacgaaggtcgtgaagggtccagtccgcgccgaagctggcgttgagccgctcgaacatccggtgggcgccgtggtaggtcaacggctgaaacggacgccgcagcgtccaccacactggccgcgtcaggccccgcggcaccagcccgtgcagctcctgctggtagagccgcagccacacgaacgcatccgctgaggccggcacctgctgccgtgcccgggagcccttccggacaacgctgatcagctgctgtcccggatcgacgtcgcactgacggacgccgatcaactccgatgcccggaccccgctggagatccaaaacgcgatcatggcccggtcccggttcgacggcagcgccgcgaacagcgtgttgaaccactcgtccgggatcgagcgcggaatccggcgcggaatcgtgggccgataacggccggtccgctccggcgcccaggtttccatcgggttgtggtgcgcgtgcgcgcggccggaacgacgagccaggtccagcggaaacgggttgagcaacggcccggatccggcgtcacggtgcaggtcgtagaaccggcgcagcaccgtctcgctgtgggcgacggtcgacggggcatagccgagcccagggctcgttttcccggtcaccgggttcggggcgccgacggtgcgggccggctgccgcttggccgccgtcgctcgcggcttgaccgtcagctggatccagcagctgaaatcccgagcgtccatgcgtgtcgctcgattccacggcacctcgactgcgtgcaggaaccgccaccaccgcagtaggtccatgccgtaggagcggacggtcgcggccgctttcccggctgcgagcagctcctggaagaacactgcgaccggtgccacggtcgcgccgtcggcgtcgacgagccggtagggctcgtaccggtcgccgatttccaccagccggccccaccgaggaacggccaatctcgacagatcccgttcgggcacacgatcgttcatcacgaccgcagaccgtactgggcgacaacctcacctgtgccctgaactgcacaatcaacgtgcttcgttcagtcaacggggcatccgttgcccggtcctccaggtcaaccccaagatgttgtcccggctcgaagagctggagaaggacctaatcctgcggcgcaagcgggccgaactcgaaggatggctgggagagatcgacggcatcgacaagaccctgaccttcctccgggccaagcgcattgaggccgaaaggatcaagcaacgaaccgccgtccacctcggcctgccccacgtccgtcgccccaggactgatcaaactgtcaccgaatgatgacgctcacgccctgttcttcgaagatctccaggagtaggtcgaacaacgcgacttcgcgttctccggagggcacacggtcttgcagccgtgccttggcctgggctgaggaatcccagtgcacggtgaacggcgtagtggcaccccagccccctctcaggcagtcgctcagagcatcgaggttcgagccgaagtatccgccggggccgttgatggcttcaccgatcgcgcagtagaagctgtctcggtcaacgatgtgccgaccgtccaaggtgaacacctggcctgcaggagcgtcggccttcccctggcgttggtactcctgggaacacagcgtcaccgacagccatgctcgtctgtcctcgggggcgaactcgtgccacataccggtgcggtccagatgacccgtgcggatcaggtcccatactcgttccgctccggccacggcgttctcgcaccacagcgtcatcgtgaggtcgacgaggccggccccgcaggcggagggcttgacgtcgacgacggtgacctcattgacgaagtaggaccccatggtggcaccgtcaccgtcgaggagctcgaaccaggcattccccgccaaggcgcgacgactgccgacgtggccaacgctctccagtaggccgccctgcgggaggcagcccgtgaggtgcactcggcgtgttccctcttcgtccggcagcggcgtgaacaacccctcggcctcgtgagcaaagccccagaagtcagcgtcgtcctcatccgaggtcagggcgtactcctgcccctcaccgctccgacctgatgttcgcatcgcactccccatgagagcgctgatcttaccggcgccccggtgacctggtaggcggtcgccgacctgtccaccccatgacacttcggaggctcttggacgagtcacggatccccatagcccgtgagagtgaagtgcagagaagggtcatccagtgcaagcacaggaaggacggctggtcgggcaagcccgtcgggagccctgaccttcaggtcctgaacggcactggcaggcaggtccaccacggtgatgtcgtggtcatgttgaccaacggccgtatcaccgccaacgccgcgcagttcgcgaagtctcagcggcttcacctcgtcgaccgccatctcctcgccgaatgggccggcgggtcccatcccctgtgggaactcctgcacgccctccctcctgccagccgccgagaggctccctaggggtcgccaccacctatgaaacgcccggcctcggacgaaactctcgatctcgcccacccgcaggcatccggctgacacaatgactcggctgggcttgaggacagtggaagaacctacatgtagtgaccgcttggaaatgcggcgcgaacaggccacgtcccccgccaaacgtccgacccgtggacgattgcctggcactccgactacaagttttgtcatgcccggaggaggacgacgcgacgggtccgcgtcggcctgcactatgcatgacctcttccccaacaccctggcggggatcttgagcggggtgggaaccttcatcaccctcgccacagctacttgggctcgtacgcgtctgggctctcgcagcagatccgcgggacctgattctcaactgagccctgtcgttccaaccctgggagcgagcgaagaggtgaggccgtccgacgcctcatccgtccagggaagcacaaccatgcctagcaccccccgcacctacaccgccatcagcactctcggtgctgatggccgcccggctcacttcatcactgcccagccggtcggcgcggtcgtcatccagcagttcgggacccgtccggagcggttcctactcaccgatgtccagctcgccgacggctccttcgtcgccgagccgctcgaccgctacctgtaaaccagggtgggccgcgcctgccccatcgcggtccggctacaggatggtcaggtgctgtcgcacggcgctggcgagctcggcgtagaagtcgatgcggtcctgggcctggaggacctgggcgcacacggtcagcatgccggtgcgggcctcgggccggtccaggacgcaggccagccgggtccggatgtgcgctgccgtctcgggggtgagcagtgtgtacacgtagagggtggctgcgtcgtagccgtacggggcgcggccccatccctcccagtccaggatgtgcggggtgcgggtgatgttcgcccagtggaggtctccgtgggcggtggtccaggtgacgtcgtcgacctggtggccggtgaattcggggatgacgcggcgcaggtactcctcgcgtacggcctcgcggtccgccggcgggggcacgtcggcgagggcgtccagggcggccgtcatctccttccaccacgtctcgggcaggctggggtcctcagtgaggacggggcgcggggagacgatcgggttcggggtgaaggcgtatggctcggcccggtaggcgtacgcctggtcggtccagtcccggacgtggagcagttcggggcgtggcaccgaggcggggagggtgcgggaggtggacgggccgttccacaggatgccgccttcggtgccggcctcggcgcagaccacgcggagccagtgcgggccggcggccgacagggtgcggccctggtacccccacacccggcggccggtggcgcgcaggccgaactggtcggcggcgtgctgctgggcggccagcatccggtcgacggtggcgggggcgggggcctcgaacatggcggtcctacctgtgggagacggctgccgcgtccttggataccagctcggtggcgagcgccgcgacctgttccatggtgaggccggagcgctcggccaggtccccgaaggtgaggcgggcgccggagaccagggcctccaaggcggggcggacggaggtgtggagctcccaacggcaggcccgcgtgctgcgcgagctcagccagcgggccttacccgatccggaggagcacactgccggccagccagcccccatcgacaccagggttcagcaccggcgccgcgagttcgccgccacggaaaccgcggccctgcgccggggccgcgatcacgctgccgcaggccgccccgctgaggcccacagcatgaccggaacagttggagacaagggagcggcctgactcgccccgccccccgctacccttctgatcctcatctatggggggagtcgctgcgtgcgcgccttggaagacataaggaaccaggtgaggtctctgacctcccgccgctacgtggacgaggcgattgccgcgtacggcgcgtccgcttaccgctccgcgttgatgtcgacctggatcgccgtggccgcagacatcatcggcaagatccgcttgcttgcggacgaaggagagggcgtcgccgtcagcctgcgtgattcgctgaacaacgcaatagcatccaacgacgtccccgccctgcagaagttcgagacgagcctgatcaagacggcgcacgaggaccttgagctgatcggccgacgtgaggccgatgagctcacccgcctctacaaggaccgcaacctctgtgcccaccccgccttcgtcgccggaggtgaagacctcttcgacccgtcgcccgaactggtgcgggcgcacctgacagccgcagtggacgcgctgctctcccaccctgccgttaccggtcgcaaggcgatcgaaaggttcggacgggaagtcgcctccgactccttcccccgcgacgaccaaaggctcaacgaccacctgcgggccgggtacatggaccacagcaccaaagcgctgcgcgccaacttgatcaaggtgatctgcaaggaaaccctcaagcccgatcttgatctccgccaccggtggaggtgcacacgagccgcccgcgagctccagaagatcgcgcccagcgagttcgaggagcagctgcgcagtgtcctggacagtcagcagaacgggctgaccgatgctggcctcctcaccctggtcacgggcctgtgctacgtcccgggtacctgggacctgctccacaaaggcacccaggcacgcgtggaggagctgctccagacggtgacgccgttggacctggcggagacacacatgctcttccacggccctctgccgcaccctccagtcgatcacatgctcctggaccggctggaggacgtcacccggcccggtgccctgcgccacgtcaaaatcggccttgccgcttgtctgggtgatgcgccggatcgccggttggtcgctccactgatcagcttggttgcgaaggacaagggtggctggtcatacgaagccgccgcgtccgtactgaggttcattgtccagatcgcagccctgctcaccgacgaggatctggagcagttgctggctgcctgcggcgagaacgaccagatcagacacggcgcactggcacacaagcagctcggcgcgcttcggtgggccgccccacgaaccccacgcgctgacgcggcctgggcgaagtggttcggcgaggaggaacccggcggcgcatcagctgatccagcgcaatagtcgaccgtgggcgcgcgcagtcggtcgatggtggcggccaggtgctggtcctcgccgcggacggcgtggcggaaggcgagggcgagccccacgaaccggaggaggaaggggagccccgcggcctcgatcacggcgttcaggctttgggcgcggtcggtgacgccgctggttccggcgtccttgatcagggcgacgacctgggcgaggagggtgttggagcgctggtcgaggccatcgaggagctggtgggcgagtgcaagctcctcgtcgactcggtcggggtcggcgaaggagaccgcgagggcgaggcggacctgcatcatggcgcgctcgccgacggcgccgtgctgctcggcttcggcacggccggcttcgaaggcggcgacggcggccgcggtgtcggcttgggaccacaggatgtcgtcgaggacgcggtggtggcggcccttccagcccagggtggggacggcggccaaggcggtggggaagtcgccggcgagccgtgccaggttggccaggccgcggcgggccctcggcgcgaggcgcccgtcggcgtcagcgacctgccgcatcccggctcgggcggcggcgccctggtcgaggtccgtgtatgccttggcccggtagtacagggccagctcgatgacctcggtgggcagcaggccggagtcgagcacctcggtcagccgctccacggtgcgctggcggtgttcgtgctggcggcgggtgatcgcggtgaggagctctgccagggcgtctgcgggtgtgtccggggcgtcggcggtgtcggcggggagggtgagcggctcccagacggaatcgtcggtgtaggcgtagacggcgtctgtgagccagccgaggtcggcgaggttgtggtcgcgggccagccgcaggccctggcgcaggcaggcgaccaggagcaggcggctggggccgagcgtggtggccgccgtccactgctcgccgagggaggccagggcgcgggtggcggcctgctgccagtcggcgtccgtccagcggtcctcgctgtgggtgtcctcgcgcacagcggtgcggatcgcccggtgcaggtggtacggccacagcgcgtacgggttctcggcgatcagggggcgttcggtgaggcgtcgggcgggggcctgctgggtgaggccggcggcccgggtggcgagctccaggtcccaggcgtcgaggagggagacgctgcgcaggaggtggcgttcctctgccgtgaggtctgagagggtgcgggcgagcagggcggggaaggagcagtcgaagtccgccgcgacgggtgtgcggccggtgcggcggatctccaggaagtgggagacggcgaggtcgaggtggaggggcaggccgtgggagcggtgggtgatcgctgccctgatgtcggcgtcgatgaggggccgccccgcgatggtgagccgttgggcgagatgggtttcgcagtcctcgggggacaggtccccgatcaggtgcggtcggtgcgtcggtccggggcgcggggacgcttcgggtggtggagaggccgggccaggcggtggggccggtccagtcgagctggccgtagagggccgggtcggcccactgcaggcggctgcggccggcgaggacgaagaagacgttcggcatgagccagaccagccgctgcaggaggcgttccaggtcgcggtggcggtccgcggtgtcctcgtcaccgtcttcttcgcgggcagccggctcaggtcccaggccagcaggtgcgggtagtacgacagggcttccaggtccggggtggcttccagcagggctgcggtccgtgcggcgccggcgagggcctgggcgcgttcctggcgttcgcgcaaggcggtgaccagggcggaggtgagctggcctgcggccgagccgaccaggccgggcagttggagggcggccgcgagctcgccgacgccggcctggagctggctgggcagcaggttggtgaccttgcccgcgatcccggtgcgccggatgtattcgtcgaggggctcgccggggtggacggtctcccagtagtttcgcagtgccacgtcgaaggacggcagggttcggccgagtccgccggcgagcgcgaggcggatcgtcagcaggacgcgctcgtagtccgagccggcctgcggaacgggacaggtcgatccggatcggcaggagccgctgcgtccaggccggttcaccccactgcgcggggcggtcctcggtcgcggtcagggcggcctcgatcttgcggagcaaggtggacctcccggccccgcccaccccgtggaacatcaccaggttcgtacggggcgactcgaggtcttcgacgtcgaaaccgggccgggccacgtgctgcaggtgctcgccgagcgcggccgcgaccaccgcccactggtgctggcggtcggtgaacgcctccaccgcgtcgtactccgacgggttgttggagctgaccggagggcccgatgagcgccgtgtcggcgccggccgctgtgatgatccctgccccgcgtccgtcgatgtcttcttcggtggccgacggcgctccggtgcgtcggcagcgtgtgcgggtcccgatgcggctggtgtcgtcgccgttctactcggacgtcgcgctgtcggtgtacgtgaaggtggcggcgctggcggctcggccggggggaggggggaggcgcggtcggtgaggatcgcctcgtacctggggctgtcggtggcgtcggtggagcgggatgaaggagctgacccgtccggggccggacgggttcgtggagctgcggtcggtccgtcgtaccctgcccggcggcaaaggtcagtccgcgctgcggacggtgcggcagatgacgcggacggagaagttcgtgtgggtgccggtggcggcttcggaggacctcacgccccggcagctgcgcgcgtacgcggtcatcgtgttcgcggggaagatgggcatcgcgctgaccgagggggagctggcgggatacctgctccatcgctcgggcaggaaggccggccagcccatcacggcggcggccggtgaggtcgtcgacggtgtggaggcggcgcgatgggtgacggtgcagcggcgggcgggcgcgcagggccgtcaccgctacatcgcccacgaggccatcgtgagcggcggcgagccggtcgcggactcggtgctgaaggaggttcaggagggcgcggagcagcctgtggaaggtgtgcctgacgggacggcatgtctgttggttggtgagggatcgggtgtgtgggttggtgagggatccctcgcgaatgaggaacaacctaggactgactcacctgatgacgaaggcgcactcatctcacccgccgtaggcgaggtcccggtagtcaagggtgcctgggttgtggaaagccgcgctaccgcggaggcacgtttcgaaggcgtgggtggtgtcgcgctgcgcgcgggtgaaatcagccagccctcctcgaagccggacggcgaaaagcgcagcagcaagggcgggggggggcgtcccagtcgtcgtacaccggaccgcagctgtccatgagcccggaaacctatgccgtcctggagccggtccgcgtgctgctggagcaagtcaccagcagcttcatctcctgccacgcccagtcgccggccctgatgggcactcccgcgcctcggggcggggccgtccggtggcatccggggccgttcggcggcagtccaggtcctccgtagccgtccggccccgttctccgcgttcatggagcgtcctgccggggaaggcgtgccggggacccgtacacccgagaagggacggacaccatggcacgaccgaggatcgtggtcgtcggcgcgggattcgccggcgtctcctgcgtacgccgactggagcggacgctgtcacccggggaggcggagatcctgctggtcaccccgtcctcctaccagctctacctgcccctgctgccgcaggtggcctccggcgtcctcaccccccagtccgtggcggtctcgctgcgccgcagccgccgccaccggacccggatcgtgcccggcggggccgtgggcgtcgacacccaggccaaggtctgcgtcatccggaagatcaccggggagctggtggaccagccgtacgaccacctggtgctcgcacccgggagcgtgacccgcaccttcgacatccccggcctggcggaacacggccgcggcatgaagtcgctcgcggaggcggctcacctgcgcgaccacgtgatcgcccagctcgacctggccgatgccgccgcacccggctcggcggagcgggcctcacggctcggcttcgtggtggtgggcggcggctacgcaggtaccgagacggccgcctccctccaacgcctcaccacgaacgccgtcgcccgctacccccgcctggaccgccgggagatcacctggcacctcgtggacgtggccccgaaactgatgcccgaactcggcgaccggctgggccgggcagccctcgacgtgctgcgccgccgcggcatcgaggtctccctcggcgcctccgtcgccaaggcgggccccgaggacgtcaccctcaccgacgggcgcgtactgccctgccgcaccctcatctggaccgccggcgtcgccgcgagcccactcatcgccaccctgggcgccgagaccgccaaaagcggccggctcgtcgtcacgcccgacctgcgggtcccgggggcggacggcgcgttcgcactcggtgacgcggccgccgtgcccgacctcgctggcggcggggacgatgcggtgtgcccgcccaccgcgcagcacgccgcgcgccagggcagggtcgccgccgacaacgtcgtcgccacgctgcggggcacgccgctgcgtcagtacatccacaaggacctcggacttgtcgtggacctcggcggccgcgacggcgtctcccggccgctcggcatcgacctgcgagggatgcccgcccaggccgtggcccgcggctaccactgggcggcactgcgcaccggcgccgcgaaaacccgcgtgatgacgaactggctgctgaacgcggtggccggcgacgacttcgtccgcaccggattccagacgaacaagccgccgacactgcgcgacttcgagcacaccgaccaatacctcaccccggaggaggtacgggcccgcacagcggcccacggaggctgacagcaactccgagaacggcgctgcccctctcctccatgcccgagtctgcggccgcgccttcgaccggccgcggttacaggtgggccaggtgctcgcgcacggggtcggcgagctcggcgtagaagtcgatgcggtcctgggcttggaggatctgggcgcagacggtcagcagccggttcgggcctcgggccggtccaggacggcggcgagttcggtccggatgcgggcggccgtctcgggggtcagcggcgcgtacaggtacagggtggccgcgtcgtagccgtacggggcgcggccccacccctcccagtccaggatgtgcgggccgcgggtgatgttgccgtagtggaggtcgccgtgggcggtggtccaggtgacgtcctcgacctggtggccggtgaactcggggatgacgcggcgcaggtactcctcccggacggcctcgcggtccgccggcggtggcacatcggcgagggcgtccagggcgccgtcatgtccttccaccacgtctcgggcaggcccgggtcctcgtcgacgacggggcgcggggagaccatcgggtccggggcaagggcatacagctcggctcggtaggcgtacgcctcggtggtttagtcgcggacgtggagcagttcggggcgtggcaccgaggcggggagggtgcgggaggcgtagcggccgtcccacagggtgccgccttcggtgccggcctcggcgcagaccacgcagagccctccagtctgggctggtcggcggcgtgctgttgggcggccagcatccggtcagcagtggcgggggcgggtgtcgaacatggcggtcctacctgggtgggagagggcggccgcgtccttggataccagctcggtggcaagggccgcgactgttccacggtgagacccgagctctcggccagggccgcgaaggtgaagcgggcacctgagatcaggggctcgagtacggggcggacgcagggggtggtggagcaacagcttcaccagcttctcgtcgaaatccgcacactgatggtcgtgagcgaggattccccgtcgttcagaagccttgggtccccgccgcaaatgaggcagcagggacacaaggcgggaagcactcatccggcctgaagggaatgcatcatcacctgaagcgcgcctcgccattctcgatatagagaatcagagggctgattattgcttcatcttccgcaagtagtggatgcaactccacgcctctatcgcggatttcttttaccggccccatctggtcggcagggaatcgattcttggccgtctcgttctgtgcctcgaagaggccttcgagttccgaattccagccaggcagcggaacgaacttgcagatgatccaaggctgatcgaagccgtgcgggtggagatcgcctaccggctcgccaccgatgtacaccctccatgaagccgagggcgaggcgttcccttcttctcttaccactctagctcctaccgatatccttcatgacttgttccagggttgtgccgggcggccagtagtgaactatcgcttcggcctccaggcgcaagtacacgagcagttcattatgcctggtggcgttatctgacaattcatccccgaaaactgctcgaatgtgttccgggacagtcagattcttggccgcgtcgaaaatcctggaattcgtcttgctgaggtcgagggaaacgtaaccgtattcgccacttcccttccatcctgtcacgctgccgctgccgtaggtgtcgaacatcgtcttggggctggtcgtgaccgatatccatggagagtttgcgtggcccatgacgtgctcccacggctcgacagactcgtcggctcctggccgtacaagactggctccaggcccttccccctttcgcaaggaccggaaggcattgggcgatccgagggcgaaggcttgggcccggggggctgcgaggctacggatccagctgaatgcgggtccgatgaggctgctgctgcctccgccggctgcgcctagaagtagatcccaggggtccgtcgggcggcaattcgcttcgttgactgcgtaggagaagcccgcacccacggcagcgttgactgctgttgatgtagcgagtgcccgtccgccagtcaggccgagggatcgggctgcgaagctgcctgtgccggcatgaggaggccggcgatgccgccgaccagagcgccctttccggccgccttgccgaatccgctggcggtgaaacctccgttgcgatggtgccaggtgtagatgccaccttccaccacagcgccgaaggcagccccgattccggcgctgacgcaaagggggcaggcaccggatgggtcagactggttgacggggtcgttgttggcgtaggcataggtggaagagttcgtcggtgaggctgtgtccggacgggggtccgggctggtgaagcggccggccttcgggtcgtacccgcgggctggaagatcgatctttccccgggatacttggtctttgaaacttcctgtgaagccgaagacgctggtctgctgtgtgccgccgccggctgttccggtgaaggtgccccaggttccgtaggcgtacttgtagttctcgacccccgacaggtcccggaccgaggtaatcgagttctgccggtcgtgcaggtagtagaagcttgccactccgggtcagcttgcagccggccgccaccagcggtgcggtcacggcttcgttcaggatgacttccttgcgggtgtcacagccgtccgagctgctgagcccgcgattccggtgcttgtacaggtcccgcttgtacccggcccgctgctcgtcggcggccgggatccggtcgatcgcctcgaagagcgggaccggggcgcgaagccgggtggcgctcggtgcggccgccgctgagtgggcatctgcgcgggacggttcggcgtgggcgttgggcacgcctgcggtaaggagtttgatcacgaccggggttgtagcgggtctgaagtgcggttgcccagcccgatgtcggctccttcacccagctgggtgggggactcactgcggaaacgatcgtccgacgggcgaggtcgaggtcgtggtcgagcaggggcgtgcgcgggcgtgtgggggcgcacaaggaagcggatgcgctcgctccagaagttctgccgggacggcctgaacgttcgtggggcggtttcgattggctggggataggagctgccccgtggcggctccccggctgccgactggggaggcacgcctggatctaccggctgaagtacgcctggaaggacttcctgctccgtggacatcaccgaaccgctcgctctggcactgataggggcaactgccgtgcgggtgttcgcccctgacgtggcgcgagggctccgtcgcctgctgggcgccggagtgcgggtaggcgctgccgaactcaccgcaggccgcagcccggggtccggtcacctggaccggacgcgtgacatgccgactgccggcctgaacagcgccggcgagcagccgtgggggatctcatgaccgacgctgaggacgatccgttcggagagcaggcggtcgacgtcgagctcgccggcgtctccggtggagttcgttgcattccactcacaacacggcccggccttcgtgcgctacgcgcagtgggagctcggcgacgccagggtcgccgcgacagtcgtcgaggacgtgttcacgttcctgctgcaggtttggcccgaagcgctgtaggaagccagcctctccgggttcgcctggtcccacctgcgcgagcacgtcgcacgctacaaggcggccgaggtcattcccgtcgcgctggtgaagaccgcccagtacgccgcactgcggcgtacctcccggcggcgtctgaaggctcaaccggtttccacgctcggcctatacaaggcgatcgccgagctgcccgagcggcactacgacgtcgtactcctgaccttcgtcctggacctggagcggagaaaggtcgcgcagctgatgggtatctccacaaccacggtgcgctcccacatctacaccgcacgccgcatgcttgccgaaaagatcgacttggactggactcccggagaggagaagggcctgagaacgacacaaccggcgaccctgccggatcgccgagtgaagtggacaacgaggctctcctggccgccgaagtcttcaccggcgactacgccttctacgacgagaccgccgcacgccgccgcattgcccagcgcgtggtcgggcaccgcaagggcgtggcggttccgcgccccacgggcggtgccctgctctcggtcccgcacagcgccgcagccaccggctggggggtgccggccagccgggccgaccgtcagctggtgctggacgcggcgtgccacgtgcgggcgcccgtgctctcgaccggctcgcccgggctctggtcgacagctcggagttcacccggatcgctttggacgcggacgcctggccctacagccggccgtccgcccttctgttcgcgagcctgctgcacctgtccggccggatggagggcgcccagttctggtttcagtacgccgcgggcgccggctcggccaccgctgcccgcgccctctacctcctgcacctgtcccggtccgaggtcaccatcgctcaccactggcagaagcagaccaccagcaccaccaacgacgacgaggccggcctgcccgccctgcctaccgttcccgaggacctggaatcctccctgggtgcctccgtcatctgggcctcgccccccatctccaccaccgacctggccccccacccgcccaccgacctcaaagccctgcgccagttccccctgccgctgcaccgggcgatgaccgccctcgttccccgcgaggacctcgcccacggcgaggtctaccggaccaccagccagctcgcctcggccctggcacgatgcgccggcctcgccccggccggcctcaccgccgacgccaagcaaggagcccgggtcgcccgccgggcccaccgccggccgacctgctccagcctggccgccgcccaccgggccctgcgcgtactcgaggtcgtccaccgccacaccggcggcgtacgcctcacccaaatcgcgcgcgagaccggcctgggacagctccacctcaaccaagccctccaacaactcgtccgcgcccacctcgccacccccatcacccccgacgtatacaccgccggctccgccctgcagctcgcggccgccgaccgcgaccgcatgggcgagctccgcgacaccctcggctacctacgcgacgcggtcggagcagccgtctacgtcgccagctataccgagggcgacgtatccatcacccaatacgccgacggcccccgcaccccggtggtccacgagtgggtcgatgcggcgaagccgcccatgcctccgccgtcggcaaggccctcctggcccagctcggaccggacgaacgccgcgaccacctcacccggtaccgcatggaaccgttcaccccccacaccatcacaagccccgaggtcctcttcgacggactcgacgaccgccgccccagccagcccctgctcgacctgcaggagtacaccctcggcaccgtctgcgccgccgtccccatcggcaccggcaccgacccccagtgcgtggccctgtccctacctaccgccgaccccgaccgactcaggcaagcagcacacgtcctgcgcaacgaagccgtcggggccgcagtacgtcaggggtcaggtactggtgtgcaggtgctcctggcgcgcccggaccagggcgcgccatccggtgcgtgcctgctcttcgccgtcgatccatcgggcggtcgaggcctcggtgagcgtcaggtcggccatgtagtgggcgatgtcgtagtagtaggtgtagtcaccgccccggacatggttgcgcagccggtcgatcgcggcacggccctcgtccggcgggtcgccgggcttctacggcgcgctcgtccgcgagctccagcagcagatcgaggcgttcgaacgcgccgaggaagagctgggctggctgcgctcgtacgccgcgcgtcctggcactccgatcgtctacgacacgaacatgctggtgcactggcggccgccggacgaggtgaagtggaccgaggtgctgagggctgagggagtgcgcaccaaggaagtccgcctggtggtgccgctggtcgtcatagatgagctggaccggcacaagtctggtgccggcgagcgggccgcgaaggccctccggtatctggggtcccagcagtactcgccgagaaaacaacggagtagcccctgacctggaccgttgctgttgagacgtcggctcgttgggctgaacgagtgagtccggtgttgggaggggcggatggcaacgcgggtgttctccgacgaggagttggagggcctacggtcgttcccggcgatcggcaaggatgagctgatccgctatttcactctggccccggccgatgtggcgttcttgcggaagttcctgcgtccgcagacggtgctgggcgctgcggtgcagttgtgcacgctgccgtgcccggagctgctttcctcccgggcgctggggtgtgctggaaccaggatgctgcgggtcgcttcctgttccgaatcgaactgccctgccgcaatatgaagtggcggaccgtcagccgggggcggtagtggcgagggggagcgggcatgtcgcaggggtggaagatcacggtcatagtgctggcggtggccggggtcgtctcgacgccattggtctggctgctggacggccccgatgcgggacagctggccggagcctgcgttcaggccgccgccggtattgcggctctggtctgggcgttgtttcagcacccgggaaaccgtgcggacgatacggccgtgcgcaccgggccggcccgcgcggacgatggtggaacagcgctgacgggggtcaggcgcccgcagggccggggcagtggctcggcacaggcggaaaggaccggcggcgccaccgccaccggcgacggcagcaacgccgtcagcggcatcgactacacctgacggcgcccagcccggtcagaacacaaaaagcgggggaatcggtcgcgtgaccgcaggagacaagagccagcaaggccccatcgacgccgccgacgctgacgtcgcggtgaccgataccgggaacgctgcggccgcgtcgggggccacagcggtgagcggctaccgcggaccggtaccgggaaccgacggcacccccgctgctccggtacggatatccgggaccggggatgcggccgcgtccgagggcgggctcgccaacaccggctacatccaccaggtgagcgtcgagaagctgaccgtggtgcaacccagcgcggcccgggagccggccccgtggccgcaccaggtcggggttatcccttcccgtgcacggtctttccaggatcgcgccgaggcggagcggctgcgggcgacggtcgacggcggcggcaccgctgtactgggccaggtcctgaccggtatgggcggggtgggcaagacccagctcgctgccgactacgcccgcaccgcatgggaggacggcagccaggctggcggcctggacgtcctggtctggctcactgccagcagcagggaggccatcgtgagcggatacgcgcaggccggagtcgagttgtgccgggccgatcccagtgatccggagaaggccgccgaatccttcctggcctggctcacccccaagacgggagccataccgtgccggtggctgatcgtcctggacgacgtcgccgacccggcggacctgcaccgcctgtggccgcccgccggcccccgcggccgcaccctggtcaccacccgccgccgtgacgccgccctcgccgcagacggccgccacacggtcgaggtcggcctgttcaccacggacgaagccctcacctacctcaccacatccctggccacgcacggccgggtcgaaccagcagaccaactcaccgctctggccggcgatctcggacacctgcccctggccctcgcccaggccgtcgcctacctcatcgactccggcgacgacatcgccacctaccgcacactgctggctgaccgcgccaccacgctcgccgacaccgcccccgaccgcctgcccgacgaccaggcccgccccctggccgccgcctggtccctgtccatcgaccgcgccgacaccttgcggccggccggcctggcccgccccatgctccaactcgccgcgatgctcgacgccaacggcatcccccacgacgtgctgaccagtgcccccgccctcacccacctggccgcacaccgcacccaggccgaccctggacgcgcgcggcggctgaagtggtggccgggcaaacggcagcgctcctcagtacaggccacccgcgaggacgcgacgggagccctgcgggccctgtaccggctcagcctcatcgaccacacacccaccaccccgaaccaggccgtccgcgtccaccagctcatccagcgcgccacccgcgacaccctcaccccccaccactacgaccacaccgcccgcaccgccgccgacgccctcagagccgcctggccagcaatcgaacgcgacaccgccctcgcccagaccctgcgcgccaacaccaccgctctggccacttgcgccgaagacgccctgtaccggcccgacgcacatgcagtgctgttccgcaccggctacagctacggccaggccggccaggtgaccgccgcccgagaccacttccggcacctcgccgacatcgcccgacacggccgcggcaccgaccaccccgacaccctcgccgcccggtacaacctcgctttgtggcggggggaggcgggggatgcggctggcgccgcggcagctttcgccgagctgctcgccgaccaggtgcgggtgctgggcgaagaccaccccgacaccctccccacccggaacaaactcgctgcgtggcggggggaggcgggggatgcggctggcgccgcggcagctttcgccgagctgctcgccgaccaggtgcgggtgctgggcgaagaccaccccgacaccctcgtcacccggaacaatctcgctgcgtggcggggggaggcgggggatgcggctggcgccgcggcagctttcgccgagctgctcgccgaccaggtgcgggtgctgggcgaagaccaccccgacaccctccccacccggaacaatctcgctgcgtggcggggggaggcgggggatgcggctggcgccgcggcagctttcgccgagctgctcgccgaccgcgtgcgggtgctgggcgaagaccaccccgacaccctcgtcacccggaacaatctcgctgcgtggcggggggaggcgggggatgcggctggcgccgcggcagctttcgccgagctgctcgccgaccaggtgcgggtgctgggcgaagaccaccccgacaccctcctcacccgaagtaacctcgcccagtggcggggcaatgcgggagatgtggtcggcgccgccacctccgcagccgcgctgctcgcagaccgcgtgcgggtgctgggcgaagaccacccccgcaccctcgccacccggaacaacctcgctttgtggcggggggaggcgggggatgcggtcggcgctgcggccgacctcgccgagctgctcgccgaccaggtgcgggtgctgggcgaagaccaccccctcaccctcgtcaccctgagcaacctcgcctgttggagaggcaaggcagaaggggactccccaagtgccgggtagcgatcgttcgtgaggcacctccgccaccaccacgttttcgcaggtcgcctctgtaacgcttcccgtgtacgtgccgatgccatgcactcaggggttggtgagactcgccacgtcatcgcaggtcagacccaactccgttgctttctcggcgagaactaccgcaacccccactggcggccgccggacgaggtgaagtggaccgaggtgctgagggctgagggagtgcgcaccaaggaagtccgcctggtggtgccgctggtcgtcgctgcggaactggaccagctcaagccggaggcgggcacccgggtgctcagcgacgacttcggtatgcacctgcgggctcaggggctgtctctgcaggccatgcggcttcctgccgactatcgcaagggtggttcagctgctggcggctgagcgtggcaccggaggcgaagtggaggagaatgatccctttaccgtcaagatcattccggaaagggtggtccccgtgtcggacccgaacactcccagctttgagcccttggatggcgacgaggaccagctcgcgcgcgacgccgtgcgggaggtcatcgccttccacaacgcccggatcgtcgacgagcgcagggcgcccgtgccggacgacgagcgtattgagcagctgaagacggcccggcaggccgcgatcgatgaacagacgcgtctggagaccgccggcctcggcgaggccgcccgtatcgcagccgactactcggcccggctcaagggacttaccggccagtcgtagagcccggcgggcaggggcagaggccacgcctcgggccgggggcggccgatccggggcggctgcatccgggccggcatcagcggccgggccagccccgcgatctcgtccagctcccgccggtgccgcggcagtgcctcgcgcagcgcccggtgcagcgccaggaacgcggctgcctccgcctcggtgtaggggcgggcccgctccccggcgagcgcccgggccagctgggtgctgccgtgctcggagcgcagcagggcctggccgtcgcggcggaccatggtaacggccgagaccgctggatgcccggccgcgaggtcggcgatgtcggtgagtgcctggaagctgtggacgatcgcgtatttctccaggggcaagttcacgtaattccccagggcctggcgttgagccggggctgctatccccgaccagcttccccgagcatgctctcctgagccggagactgggcctcgacgatgagtactgtcatgccagtgtcggtccaggtctcgtgctcctcgcctgcggcccaacaggcagcttgtcccctcatcagggcctcaggttcgccgtctgcgccgcaggcccacccctggccttctgtaacgatgaggacctgtggcactggcgcgacatgccgcccgaggcgtccgcctggggccaggtgcatgatgttcacggcggcagaaccgcttccgccgtgaacacggacacgtcggacaccttgactgccgtaggccgtcgtctgtgagccgacaatcgtgtcgatgtcgaggatcttcatgcaggcattctgagggagcctgtcgcacctcggaacggcggcctacgtgagacgagtgtgagccctgctgatcagggacttagcctatttttcggtggggttccttggccgcttgttcgggcggtagctgggtccgttcatgatcacctggtggctggtgttgatgagccggtccaggagggactcggcgacgacagggttggggaagagcggataccagtcgctgggtgcccggttgctggtaatggtcagcgaccggccctgccgttcgctgaccagctcgcagaggccatcggcctgggccgcgccgagctggcgcatggcgaagtcgtcgaggatgagcacgtcgggccgtaccagttcacggatccgcttgtcccaggggcggtccgcgtgtccgccggcgaggtccgcgacctgttccacggtgaggccggagcgctcggccaggtccccgaaggtgaggcgggtgccggagactagggcctacattgcggggcgggcggaggtgtggagctcccattcgtgtccggcggcgcgcagcacgacggcctcgtcggttccctccagcgcggcccgggcggtggtgagggccaggaccaggccggggtcggcggggacgtcgccgatgtacgggagggatggggccgggcggccggggtcgcggccgtccagggagacggcgaactccgagacgatgtgggggtggagggcctcagacacctccttgcccccagcaggccgccgagagccctcctgaagcactactccctgacaggtcgttctaccaacggtagaatccgctgcatgagcagcagcaagcccacgagtatcaaagcgaccgaggcgacccgcgaccggctgcgcctcctcgcgcaagagcgcggcacgaccatcaccgagctcctcgaggagctcgcccagagtcggctgacccggtcggagcaggagcagcgggcccgcctggccgcggcggaactcgggctggagtacaccgaggacctccagcaggccgggcagtccgcctgggacaagatccgcgcccatcagggcggcaccgccgcgtgagcctgacggccgtcttcgaccacaccgccctggtcgccctttaccaggccgaccccttcttcaccggcctctacatcgaatcctcccggggcaccggccgtgtcctgatcccggcactgtctgtcctcgccgccgaacgcgcgacccccggggccggctctcgcgccgcccggctgcgatttgccgaagctgtgcccttcacgaccgcccacgcactggacgccggctcctggcccgccaccgactgggcggtcactcaccctgcggccatcgcctggcaggccgccaagaccggtgagcccgtcaccgtcctgtccctgacccccgaggcgtacgagggcaccggcgtctaccctctcgaccccacctaaccaggacggccgcgatgccggaggtcacgcacaagcgcgaccacggcttcgggatcatcaagtccggcgacagcagtgagcgtgcagatcggcaacctcggccagaagatcgaccgaaaccaggaccggatcattcgaccttctcacgcagctggccggacagcgctccgacgccggctgacctcccgggccggcccccggccttgccttcctgcggccccgaacccagcactctggttcggggtcgcagtacgtttgcgatcagcgggtggcgcgtaggagttccggtcgggggcggagccgggctgcccgcccagaacggtcgccaccaggagggccgccgggaaagccgggccagcacgaagtgagcctcctcgcaacgggcttcaacatgcttccgctgggtgtctgccagccccgtcggtggtggagagtgacggatcacatgcttcgctggtcgtgggtgtcctggcggagctggttggtgtgccgggtcagggcgtcgatgcgttcggcgaggtcggcgtcctggggccgcaggtgggttcgggtggcggtcagggggcgcacgaggcgggcggcgtcgttgtcggcgagagccaggttcaggtcgccgaccgcgtctctggcgctggcgggcaggtcggtgagggcggtgatctggcctgcgaggcggcggaggtcagcagcgttgtcgcgggcccaggcggtcacgctgcggtcggcggcgcgggtgtcgcgggtggcctggacgcgttcctcgccggtgcttccggcggtgccgggacgcaggcgcaggtagcggcgttcggcggcctggcggctggcgaccccgaggggtccggcgaggtcggcccagctggcaccctcgcggcgggcggtttcgatcagcccactttcccagccggcgagttcctcgcggacctcgcgcagcatcagcagtgcggccagggccgggtgcgggccggagtcggccgcgggcggtgctgtcgccggtgttcccgcggaggattgctgcgccttctttacggactggttgatgtcctccagcgctgcggctgcggcaaggaaggggactggtgtggccggcggggcggcttcgttcatgagactctccgtcgctctgtcatcctccagatgactccctgcttgtcatcgtttcgatgacatgctacaacggtggcacgttgaagcgcattggcagttcctgcctgaaccaactggaggtgtttcgcgatgttgatgcgcaccgacccgttccgcgagatggacaggatcgtccagcagctgtcgggtacgtccgggacctggtccaagccgtcggtcatgccgatggacgcctaccgcgaaggcgacgtgtacgtgatcgccttcgaccttccgggggtgagccccgacgcggtcgacatcgacgtcgagcggaacatgctgacggtcaaggcggagcgccggccggccgccaagggcgacaccgtgcagatggagctctccgagcggcccctgggtgtcttctcccgccagatcatgctggccgacaccctcgacaccgagcgcatcgaagccgactacgacgcgggtgtcctgaccctgcggatcccaatcgccgagcgcgccaagccccgcaagatcagcatcggcggagcggcggaccgcaagcagatctccggctagaacctgcccgcgtcagccggcagaggagggcgggaggagccagatccccctccggcaccccgccctccgcaccccctggacccttcatgccttccccggaggtgacgtgatgccgatacgcagggagacgttcctggcccacgttcaggaacgcggcgagtacgagacgacggaagaagccgaccgcgtttcccgcgtcgtcctggccctgctgggcgcacacctggtcggcaccgtgcgggccgagctcgccgcccgtctccccgagacctacgccctcatcctgctgaacccgttgcaggcctcggagccgctttcgccggaccggttcgtccgcgcgaccgcggcctggatcgagggcgccaccgagaagaccgccctgtgggacatcggcgcggtcctgtccaccgcggccgccgcggcgggcaacaccctcacccgagatgtcctcctccagctcccgcccggttacgacctcctcttcggccacccccggcccacctgaccaccacgctccgaaagccggatccttcacacagaaagggcaactgcagccatgtacgaccagcctcgagcgaacccgtcccggacggccatgacgttcgatcagatgctggaacgcgtgcgctacgaaggcgcctatcccacccgcgaacgcgccgaggaagccgtccgcaccgtcctggccgccctcggccgccagctcaccggcgacgagcgcgtcgacctcgcccagtgcctgcccgtcgaggcagccctcaccctgaccgcccagatccccgacacccaacacctcaccggctggggcttcgtcaaagacctcgctgtccgcaccggcgccaccccggccaccgtccgctgggacaccggcgccgtcctcgccgtcgtcacccgcctcgccggacccgacctcctcgcccgcatcctccgccggctccccggcggctacgccctccttttcggccaggccgaactgcgccagacccagctgcgcgccgcagccgcctgagggcttggcacagcaccaggatgcatggtgtggcccggtcgcgctgcgggccggccacgccgtgcatcccggccggtgatgctgcgatcggacccacgacccaggtccgtctgattgggattccgcttgtgtgggcacacgcccgcgcaagccattcgtgcaggggaggaacgctttcatgtctcacgtcgccacagccgccattcccgcccgggagaccgccccggacgccttcatccgtgccgaacccgcagccgccaccgggcagctcgcggggcccctgccgcggatcgacaacgcccgcgaagtggcgcccgcggacgcgcgtgagctgtcgcgtctcttcctggtgcggctgcgggagctggaagaggggacccgggagtaccagtacgcgcgcaacaccctgatcgagatgaacatctccctcgtccgctttgcagcacgcaggttcaccgcccgcatcaacgccggcatcgagctcgacgacgtcatccaggtcggtacgatcggcctgatcaaggccatcgaccgcttcgactccgagcgcgaggtcgagttctccaccctcgccctcccctacatcaccggtgagatcaagcggtacttccgcgacaccacctgggccgtgcacgtcccccgccgcctgcaggaactccgcatcgaactcgccaagtcccaggagaccctcactgaggctctcgggtgcgcaccgagcgtcaaggagatcgccgagcacctcgaactctccgaggaagacgtcatcgagggactggtggccgccaacggctacaacagcgactccatcgactcggccaccggcgccacggagcgcacggccgcgcgccgcgagagccggccgctgagcgacacggtcggtgacgtcgacccggccatggtcctctttgaggacttccacaccctcgcgccgctcttgcgcgaactcgacgaacgcgaccgcaagattcttcggatgcgcttcggccaggagatgacccagtccgagatcggtgccgagctcggcatctcgcagatgcaggtgtcgcgcctgctcacccgcatcctgacccgcctgcgcagtggcatgctcaccgcctaggcaggccgtgcaccgcagtcgtggtccggcacgtacgagagccatcgacgccaagggcctgggcttccttcccgggggacgtgcggcacaggggcccatgccgccgcgaccacctaaatcaggcggcgggcacgggccggacggcacgcggggtgcagtcaagtaggcgaggcggacacactgcagggccgggaccactcctgcggtcccggccctgcggcatgccgatcagtgcttgaagacatccttgaccttcttcttggccttgcgggcgtcgcccttggcctgctccgcgcggccctcggcggtcagccgctcgttgcccgtcaggcggccggcggtctccttgagcttgcccttggcctgctcgcccttcgcctcggccttctgctcaccagacacagctgatcactccctcttcggaggaaacgccctacgcaaccccgtatggccgctgagagctctcgcaaacggggtcggctgcgacagggcccggctcacgagggccgcgctacgggccggcgcgctaccgggggaggagagcgcggaccgtcttgccgcctccgggcccgggcgtgacgacggtggcgagggacaggtcgttgaccatgtgccagtcaaatccacgcgtcccgtcgacgaagtcgggagcccgcatccgcggcatcgacgggctgggatcctcgacagcgacctcgatgcagctgggtgcgcgatcaggcggagggtgtgggcgccaccaccgtggcgcaggtggtcgtcaccagctcggtgacgaccactacacccagggcgtgatgggagctgccgcgcgcactcgcgctctgagaagcggcgcacccccggttcaagcccgcccggccagcagtcgcggctccagcggcaactcctgtccgcccgactgggcgggcggcgcgcgtgagcgtagtggttggcggggcaccggagcgggaggtggggatgcggctggggtgcggtggtttgcggctcagcgggcggcgacgaggagaagaggcagcggcggcgcattcaggaggcctgccgccggggcacgggcgagcgcgccgagaacgcgccgtcgcggtacccgacgacgagctcgggctcccgccgggcgcggcgacggcccggtcgtgcagatcggagcgcgcccgagcggggctcgcgtcgcctctcagagctcgttgtggacgcccgccgaacacatgatgctgcatcagtcgctgagggaactcccctcggatcgccgagtgggggcgcctgaagcagttgcggcgccccgcgccggagctcgccaccaggttcggcgatcttgacgaggcgatggagtacttcgacgaggaacgggcgagcggcagccacctgctgccggtcagctcggctgcgcgcatcgtgaaccgtgaggcgctgccagccggccggcgacagcgcgtacggcccagcgcgcgctaccggcgccttcggggaaacgctgctggccgggccggcgagttcggtgacgtatgtcacttcgtgcggtgtcacgtctgcttcggcctgcggtgtcttgagggcatgagcgaacacagcaatcccagcaatcccagcaaagtcgtggtcatcggcggtgggtatgccgggacgcttgcggccaaccgcctgcgggcacgccccgacgtcgaaatcacgctggtcaatccccgagccgagttcgtcgaacgcatccgactccaccagtttgtggcccgtaccggtgaagccacgatcgactacggcacgcttctcggcgagggcatcgagctgatcgtcgacagtgccacgcgcatcgacaccgcagcccgaacggtgcagctcgaatccggacgcgggctggactacgactacctgatctatgcggtcggcagcctcacagcgattccgatgtccgtgcccggcgcgggcgatttcgccttcgacgtagctgaactggagtccgcgcagcggctgcgggccaggctggaagcgttgccccttgatgctgcggtcaccgtggtcggcggcgggttgaccgccatcgagacggccgccgagctggccgagcaaggtcgcagggtcacgatgatgtgcagcagcaccctggcgccgacgttcagcacagctggtcgccgctacatcgccagatggttgtcccggcacggtgtcgacgtactcgaagccgtctcggtgagcggggttcgccaggacgcggtcgcccttgcctctggtgaggtgcgtcagagcccgctgaccatctgggctgccggtttcggcgtgccggatctggcggcggcgagcgggctgcgcacagacaggatcggcaggctgctcaccgacgagactctgaccagcatcgacgaccagcgcatcatggcggccggtgacgctgctgctccgtcgggcgatccgctgcggatgagcggatacgctgccgggcccctcggggcgcaggcggccgacaccgtgttgagccgtatcgcgggaaccgagccaggggtgatcgacctggccttctccggggcgtgcgtcagtctcggtcgacacgccggcattcgacagctggctcgcaaggacgacaccgcggtaaacctctacatcggcggccgcatgggcgcggcgatcaaggatctgacctgcaagttcgtggtggcgaagcggatccgtggcgaggctcgcgagccgggttccatgaattggcccaagggcggcccgcgtccggcaggggcggtttccgccacagaagaggtcacctccccgtgagcacccaggcgcatgctgaacgattcaccctgttgaggccgctgctgttcaccatcgtctacgagatcctcggctcagcgaccgaatccgacgacgtgctgcaaaacagctacctgcggtgggccgaagtggacctcgcgacggtccgggacaccaagtcgtatctggcccagctggtcacccgacaggcgctcaactccttacggacgagtgcgcgccgccgcgaggactacatcggcccctggctgcccgagccgctgcttatcgacgagaacgacccctcggccgacgtgctgctcgccgagtcggtgtcgatggcaatgctcgtgctcctcgaaaccctgacccccgatgagcgcgcggtgttcgtgctgcgcgaagtgttcggcttcgggttccgcgacatcgccacagcggtgggcaaatccgtgacgacggtccgccaggtggcacaccgcgcccgcgagcacgtacaggcacggcgcaagcgcttcgagcccttcgacgccgccgataccgctcggatcactgaacagttcctgaccgccgcggccaccggcgacctggacggactgctctcgctgctcgcgccggacgtcacctggaccgccgacagcggcggcaagtccaccgcggcacgtcgaccagtggtggccgcggagaaggtggccgcagtcctcatgagcctgttccgcccggaacggctggcggatttgcggatggagagggtcaactgcaacaacacgcccgccatcgtcatcaacggcgagcgcatggaaggcgtcttcctgatcgagatggccgacgggaagatcatcaacttctacgccatccgcaacccggacaaacttctcgcggtggcggccccacgtcggatcagccgatagaagcaggcggcaagcaggtcgcctgcgcggcccgggacggcaggcagccccgtaccgcatgacccccgctgcacaggctggctacgctgccgcacgcgtcgccagggacggcgaggccgaacaacgaagcatggacggacattcacaccgagactgctgcctgtgggcgcaaccatgatcaatctcagcgttgcatcccgtaccgcgcctgcgcgcactcggtacccggcgagggtcgtcctctgcggcttccgccaggtccctgcagcctcgggcgaagtgtgcactctcagtgaaaggggggctgcttcttccgtgacgtggcgcacctcggcctgcccgctggccgccgatcccaccctcgctacagggttgtcatgaggcccgccagagacgggccaggagcccgactcggtcgaggggtgtcgtcacggcatagcgggtcggcagtactgccgggcggcgacacacagacaggcggcttggggcgcccggcgtgaacggcggcaggcgatggtgggagtcgactctgaccaggtacggcatgttcaggtccagcggcggcaagctcggcacgcacccgcgcctgccgtggctcgggaaaggcagagcgctgccgccgcatcgccacgggagctggcctgccaattggcgcgctccgtcggaatggctgaccgggagctcggtaccacttgggcgccgatgccttcccgcccgccgaacgcgccgtactgacctcactcgcgggcctcgtcgcccaggcactggaccgcgcacgcctctacgacaccaagcacgggctcgcccacaccctgcaatcggttctgctgccgcataccttgctccgtgtcgaaggtcttgatgtggccgcccgctacctacctgccggccgcggaatggacgtcggtggagacttctacgacctcatccgccgcgacgacaccacggtcaccgtcgcgatcggcgatgtccagggccacagcgttaccgccgccgccctcatgggacaggtccgcacggccgttcatgcccacgccaccgtcggcacgcctcccggcgaagtgctcgcccgcaccaaccgcctcctgatcgacctcgactccggcctgttccccagctgcctgatcgcccagatcgatctcgcgcagtgtcgcgcgcacctcgccacggccggacacccccccaccgatcctgcgccaccccgacggacgcaccgaagtccttgacgtgcccccgggcctgttgctcggcatcgatcccgacgtcgactatccgaccaccgagatcccactgcatcccggcagcgtgctcgccctgtacaccgacggactcgtcgaaatacccggcatcgatatcgaggacacaacagccgaactcgcccgccacttcgccgacgtcgaaggccgaacgatgaacgacgtcgccgacgccctcatcacatacgccaccgcatccgcaccccgttacgacgacatcgccctcctcctccaggcatcccctgaagagtgaagcgccatctgggtcccgtcagagcagtcccctcgtttaccggacggcgcgcccgcgaccgatgcgccggtgcccgtcaccccgcgcggcccactcgcctccagcaaccggtgatgcaggcgtatcaggtgggcgaggcccgcgacctccttgagctggtcgagaagaacaccgatgcatcggtcgtctcccgcctgcacggcgacggcaatcgcatcaacaagctcgtccggatcctcgggcatgcggacagtcttcaccgcttcgcaacctttcattcatgcctcagtcggcgagcctgtgggctgtttgaaggctcttccgcctggcggcttcgccgacccaggtgcgtggacgaccttgaccgcgccatttcgcgcattcacggacggcatcccggtgcctcgcgaaaccgaacggctgacccggttcgagtcattttcgacgccggactctaaagggcggggtcaggctccctcgggggtgatcaggcagaagggatggccgacggggtcctcgtagacgcggtatccgatcggcttgtccgaaccatccagcagcgtcgcgccgagggcgagcacctgggcttcagccgtatcgaggtctgtgaccatcacatcgatgtgcatttgctgagggcgcgcgggatccgtccaccgtggcgcgcgaaagccctccacccgctggaagaggaccaccggggtgcctgccgcgtcctggagcacgacgaagtcgccggtgtcggcctgccgtgagagcgacagcagcttctcgtagaagccggcgagttcatccgggtcggggcagtcgatgacaacggtgtacaggtgtccgatcacccggctcactctgccactggcccgatcgccggccagtggcagggggccagcccaaggctcgagaacaagccgagtgagtgttggacaacctaaaagtgcaggtcacaggccaagggggcgcccagaaggtctggacttgagacacctggaatgatccaatacaggatgacatcgttttgggtgggtaagcgggtgcgtctgcgcggtattgagcctggtgacgggcctgcgttcatgcgtttcgcggaagacgaggagggcttgggggacctggtcagcccgcctcggtccgcagagggataccgcgcctgggccgatgaacgggcgactgccaagtccgatagcgaccgcttccagctggcagttgaagccgtcggcacaggggagatagtcggtgccgttggctcacaccaggctgatgcgcgtaacggctggttcgagtacggcatcacgattggtgctgatcatcgtcgcaagggctacgcggcagaagccgcgatcttgctgcttcgtttcatgttccatgagcaccggtaccacaagtgccaagtacggatcttcgcgcacaaccaagcgtctctggctctccaccgtcagctcggattcgttgaggagggccgactgcgtgagctcgcgtacctctccggtcggcaccacgatgtcgtgatgatgggcatgcttgccgacgagttcgcaaaattgcactcaccgaccacgtgacggtctgaatgctcacacgacgactctggcccggcgtaccgccactagcaggccctgaatcatgacgctgctcatgcagggcacgaccctcgcccgcccgtcccatcgcctggtcgaggtctacgactcggacgcctacctgaccgacagcacggccatcgccgcagcggagcgcaacgttgtcggcggcaacggctatcacctctacttgttcagcctgcagtccgacctggaggtggcagtatccgtacgggtgtgggacgaaccgcagcctccgcccggtgaggcagagggctttacggccgtcagcctggagtcgggaaccgggatcctggtgatcggccagttcaccttcggacctgcggcggagatgtccctcccgaggccgggcgtctacgagggacacgcttcatgggccggccggatcgccgctgccgaatactacgagcacgcgctccgccaggtcgaagacgactggagcgcagcacggatccagcggctgtggcacgacaacccgcaacctgagcagtacaccctcgacctctggtacgtccgcgaacctgaacccgcagacgatgaggacgactgacctgcctccttggagcgtctgctatccgggcacgggacacgtgcctcaccgccgtgagtgcggccagaccgaactcgcggcctgtaagggggaacgcaatcgctcccacaaacaggttcgcgcccccgtcgagcacgtcgtcgcccgcatggagacctggaaatcctccgtgactgccgactcaaaggcgacggagtccaccacgccatgctcggcattgcccgcatgcacaacctggccttgacgggatgacacaggggcaggccagccatcgtcagtcgattgttgggccggcagccgaccaatgctggccacggggcctctgatatccggactccagccgaatactgctcgcatcgacaaccgcgtagtcaagaacgagcttgcgcgggtcgccgtcctcataaggccacacggtgacagagcccttcgagacagaaacatacgacgctccccgagcagtacgtgctcttgccgttcagggcctgaccgtcgaagaagaacgctccgaccacacctctcttcggcggagtcagcgggggaaggggggaagccggcggaggagtggctcgggagggcgacgccggggatatcgcgtggtccgcggtggagatgccgttgggggccggggtaaggagggcgaagcggaaggggagagcagcatcgaagaggtcggggtcggggtgcccgaggccatagcggcagggctggcgagcacgaccgtcgtgatgctgagagcgagtgtggtcaaccaatcggatctcagagaacttacttcctgagcgaggtgataacgctgaaaacgagcgtgatagtccgtcagtttggcgagggggcagactgtgcagcggcttgaaagatcgtcaacggaaatgaaaagggttcaaatgagcgtgaattggatgagggctggtgtggccatttcgctggcgctgctgctgtccgcggcgtcaggcggtggtgccttagcggcgcccactgcggatccgccccggcccatgcccagcggtgcggagctgcctgtgacgctgggggagcggatcagcatttcgaccgacgcaggggtctccggggacgccagtaacggtgtccgggtggtctcgcccgccttcgtgtcggacggcaccctgcgcatggacgatcggctcctcacggcagtcgtgacggtgtcctgcacggccgctcccggttcctacgaggtgcggttcggctcgcccgtcggcgacgagaacgtgtccaagatcgaccggttgtgggggagtgtgcgggtggcaccggttgaagcggcggaacgggaggcgtgcgaacggcgggtggcggaactgccgccggtgtcccaggaagagcgctggcccgaggactcgggatggccggcgacaccgtgggacgtacgtacggtgcgggccggggagcggatgacggcctcggacggcgtcgcgatggcaagcgacggggaggtcactctgtcatcccccgccttcacgcggtcagtggtgatgcacggtgcgaaactggtatcggccgtcgttcagatccggtgcgacgcacagcccgggctctacgccgtgcgctggaatgagcggggcaagtcggcgaagatctgggcccgctacagggtggtcgacaccgccgcaccgggctgccaggaccccgtggtcacaccgcaggcgagcgcggtccggcggtcggctccctggctgctcggcgccgccgcggccctgactgcatcaggcgccgtcggctatgccttcctccggcgccgtaaggcttcccgctgatgccgatgacgctgtttcaccggtagggaatccactcaacccatcgcaatgcggcgtggctcagcagaagcgtcgccgccgcgggaggggagtgtggcatgtcggtttcgactatggccgaaagagtccgagccgtgtcccgaacgccccatgcccaatatgtcgcggggcgcgaccgcctgcgtcgttccaggtgaggccgagagtgacagcccatgccttgatctgctggtggtagggctctggtccggtgcgcatggcgggggtgccgcggactgcataggcaggcaggcgggcctcgcccaggacggcgcgcggcaacgagagaccgaaccgctgctccagaacgccgagggatcgctcgtggtaggccacgtcatgctctttggaaggagggaagtttgcccgtgctcggcgacgaccccttctgggcgtcgttcggcgcggggctgggcgcggggttgatcgtggtgccgctcctgacggtcgtgaccatgttcgtactcgtcctgctggccggtcggcggttcgagccgccgaccggcggtccctcgcggatccggggcggctggctgatcgtgctgcccctggtcctgctgctgccggtggccctgctcgtgccactgcagtacctgatcgtgctcggcacgcaaatcgtgtacctggtgtgggtgttgccctgccaggatgcccgcgacacggcggacgtgctgcgctcgctcgccgagccggcagtccccgcggagcagcgggcccggagggcacgggcggtcgcgggactgcagggcaggccggtcgtcgaagccctggtgcaggcctcggccgacgcggagccggaggtcgccgaagcgggtctggagaccctctgcaccatctggcggcgcgacggagtcgttggcgaggacctgctgctgaagctcgacccgcaggcccaggagcgcgtccgggccctcggcgtcagggtgcggagcccttggtgagaacggcggcgatcggccgggcccctttccgttcccgggggcgaggacactgccgggcgcgggggcatgcgctaccgcggactccccgaaggcccgtgatcgtgcccgcagtgcgccgagttggcgtcctccggtgcggcgacgtcgaaccgcaggtaccgctcatcggagggcgtgaagtgggagccttccgtggcgcggcgggtccgatcggcgcatcgccgccgtcgagccgggggaagtgccgggtcggcggtccgcgttgaacggctcgccgacccgccgattgggactccagtacttgagccagagtcatgacccgtgaacaaagacccccggccggcccagatcacccaccgcctggtaggcgactgcgaggttgctgcgggaggtcagcgtgtcggggtggtcggcgcccagcgcccccttggatggtgccgcccgctgaccgggcatcggctggagcgcctgcgggaattggctggcaggtgcatgacgggttggtggagtgcggggctattttcttagggctccggaggggcggctgtccgaactcgcggaccacaggcgggcggtggcggcgtctccggtgccccggctccgccgaggggccggtccccccacgcgtgaaggaagacgaccatgtctctgggcacctggctgaaagcaggaacctccgccgccgcgctggtcctcgcggcggctaccaccgcggccgcggcacccgagcccgtaccgggcgctaccgcagcggtagtgacactccgttacgacgacagtcaggctggtggctgggaagcggccatcgcggccggggtcgcttcctggaacacgaacgtcagtaacgtacggctggtggaggccgcgcccggcgcccgggccgagatcgtcatcgtggccaccaccggctggccgcaggccaccctcggcccggtccgtccggggcgacaggtccgagtcgaactcggcgcgcaggccgtgagccaggggtacgacaagacgcgcatcgctgcgcacgagctgggccacagtctgggcctcccggacaccaagccggggccgtgttcccagctgatgtccgggtccagcgccgggacggcctgcgtcaacgccgtgcccaacgcgacggagcggtcccgcgtgcagaacgcgtacgcgaacgggctcgcggcaaccgcgccgaccgacggccgggtactcgtcgacgccccctgaccggcgggtcgggacggtgcggggcctggctggggagcgactcccagagggcggccgtgccggtccggcgggccacgtggacgggtcatccccaggcacggggagcagacttgctgtgctagggggtctcacttctcgagaccagtcgcttcaaagggccgcgaaggacttcaccagccgcccagcccgtcggctgctcggccggaaggcggcgcaggcggtgcggcgggcgccttcggtggccggctccttgccgaaggggtctgcggtgacgagatcaaccggctcggcgggaatcgtctgcgcccaccgagtggcgcgcgccggtttcgtggtgctcccggcgcggtcggcggcgggcatcgcggccggccggggagcggtgcggggacaggaagccggccgtggcggggctggcggtgcacaggcggcttgccacggtccgttggtggtacggcggttcgcccgcgggatggggcgtggcggggcggtcggccgacagacgggcggtgaagcggggccaggcaatcaggacgatggggtagacggcgtagccgatgcgggtggccggggacagcgctatcgccagaagcagccccagggccagccggtcggcggcggcgacggtgctgcgcggcgggcggagcagcagcgacgcccccacacccaccgcgctcaacgcgatcagcgccgtggtcaccgccttgccgtgaggaaggagcagaacgatcaggtacccgagcaggggactctgggcggaagacgccgtgggaccgaggcccagcgggtagaggacgacgttctggtagaaggcgctgatgtcgaccagcatcgcgggcgtgatggtcagcgccgccaggccggtggacactgccgcgcacctgaacgcggcgcgcctcccgccccgtaccgctagtacggcgacgatcaccgggatggccggccaggcggtccacttcagaacggcggccacccccacgacgaggcccgcgcgcccggcatgaccccgctgtgtgaaggccagggccaggcagagcagtccgatgaccggcgggtccacgccgccgatgctcaggggcagagcgacgacaggacaggcgatcagccacagggcgtccgtcagaccggcggaggcgccgcgcgtggtgccgctcggccccgtagcgagggcaccgcccctggtcagcacccgcacggctcccgctacggccgcgaggaacccgacgaggaaccacacgcgggcgccggcgaacggggtgtcaccgaacagcaggtgcggtatcccgaagagcgccatgccgggaaggtagggattgaagtcccttacggcgtgcggcgcggggttgtacggagttccggtggagaacagcagctcggccgcccgttccacgacgcccacttccatatgcgccctgccgatcaccgacaggtacagcagcggtacggccgccgcaccggtgacggcgaccacggccggagtgcgggcccacggcgtggacgaccgcgccgcgaccagagccgcgcaggcatatcccgccgcgccgaccaggccccacaccttctgcgaggtgtggtcgggagacgccagccccaccacgagtgccgacaccgcgcacgccagcagtaccagccggtcccaccgtcgtccgtcggcgaagggcttggctgcggagcgagaccgagaccgaggctcctgtttccgagcagcttgcgacatcaggcatcaacctttggagaagaggtgagggcatgagggcagagggcatcacgaagtgagggcggggtgagggtgagggtgagggtgagggggaaacgggagagtgccgccggtaccggagtgcttctggaggggttcgcctgcttggagaggcgcggcagggtccggcgacaacgacggtgacggccgggcgccgggcgctgggagccgggttccggtggcccggtccgtgacggcggtgcgcgcttccctggtgtggaggccgcgcaccgcacgtaaggcttctgctccggcgcgggctccggcgaccgtcatcgcgccggtccccaggggcgcggccccctcgccgggtccggcgtcggtgaacccgactgcgtgccggcgcgcggggtgttctgtgagacgccgacggctgtggcggcaccgctggacttcgtaccgcccgccggttcgccggggcggccggggacggcgtggacaggcacgcacacggcggcactcacgcggcagtgcctacgagccgcagggcggcgctcacccggtggtgctcgcgccgcgcggggtgccgcccgtggagctcttcagcacgcggtacgcggcgaagaccagtacggcgacgatggcgcaggtgagggccgtcgccacgagctggaggggccagtagtgggcgagggggtggaagtcgcggtagtagccgacggcgtcgagcttgtcgtacgtggcgcggcattcggggaagacgccgccgccgcagtaggggtccggcagtcgggcgccggtggaggtgaggatgccctcgtcgacgacgattcccgtgcctgacggagcgccctgcgcccggtcgcgtacctgggtcacgctgggccacaggtagggctgtgccgtgtggacgacggcgaacacgccggtcgtggcgacgacggaggtgccgagggcgggcagggagcggcgccagagcagaccgaccaggactccgacgacgaggcccaggagggccagggcgaccgtgagcggcccgcccgagtagaaggtcgggaagtcggaccaggacttcgcggtgtctatgcggtcctccccggccgaccaggcaaggtggtgcagcgcgaccaccattccggtgcctgcgacgacgagggtggccggcagggcgagtttggcggtgagccagcgcacgggggaaaccgactgggcccaggtcagctgagcggtgcccgtctccatttccctgctggtcagcgtggccccggcccaggcggctacgaggaaggggagggcgacgacggcgaaggtggtggcggagtagacctccttgtagcggatgatcgcgggctggtcgtaggcgcactgcgacgccccggcgcacgcgttgtactgctcccacgccgccgcggaggcgtcggtgagcgggccgcccagccacagcagcgcggccgagaggaggaccacgaggccgacccagacgcacagcgccggccggtgcaggcgcagcagccaccgggtcagacggggcgcgggggacggatgccgggtggccgcgggagcggtgggggcaacggcggtcatgcggactcctcctggggcatggcggaggcggaagtcgcctcctgggacgtgggggaggcagaagtggaatcagaagcggaagcggaagcagaatcggaggcggaggcggaggcggaggcggaggcggaagcggaagcggaagcggtgccgagagtgagcgggggcgccaccgggttgcgcaggtgggcgaggagcagcgtctccagggacaggtcgatcgtctgccagccggcgggcagcggccctgcggggcggacgagggcggtgacctggcgaccggtgatacgggattccaccgtggtgtgtggggccaggtcgaattcggcgccggtggcgacctcccgtgcgggcccggtgatcagggagtgcacggcgagcaagtcgtcgatgtcacccgccagacgcacccggccgtcgccgatcagcagcaagtggtcgcaggaatcctccagttcggcgatgacgtgtgaggacatcacgatggtggtgccgtaccgcgcggccgtggccatgagcgtgcccatcagctcgtgccgggccagcgggtcgaggtcggccaccggctcgtccagcagcagcagttccggccgcttggcgagggcgagggcgagcgccacgcgggtgcgctggccgccggacagtgagcggacacgggctccgaggtccaggccaccgcccgccgctacccgctccgcggtgtccgcgtcccagctgtcggggttgagatcggcgcccatgcggagcgtctcggcgacggtgagctgcgggtacagcggcttgtcctgggagacgaagccgatccgcggccgcgcgtgggccgggtgcccgccgagcaccgtgaccgaaccctcgctgggcgcgatcagccccgccgccagggcgagcagcgtcgacttacccgcgccgttgggccccacgagcgcactgacacgtcccgccggcagctgaaaggtgcagtcacgcagggcccatccgccgcgccgccggaacgttttccccagcccggttgcctcgatggcactggtcgtcatcggtgatcctgtcccttctcggtggtatcgaagtgctcgtccagcacgacagcgaagagcgctgccacgtcatcccgctccaggccggccgtccgagcgcgcgacgcccactcggagagctcgccccgcagcggggagtcgctcggtgtggcaccgagtgacctgcgcacgaaggtgccgaggcctcgccgggcctcgaccaggccctcgcgttccagttcccggtaggccttgagcaccgtgttcgggttgactgccgtggcctccacgacctctcgggcagtcggaagcttgtcgcccggctccagcaggcccaggcgcaaggcctgcttggtctgctggacgatctgtacgtaggtggcaaccccgctgcgccggtcgatccggtattcgatcatcccggcaaacaccctttcactatttgagtagtgaatagtggatcaaggggggtgtggatgtcaaagagggcgccggccacggggtccggcacacgtcgctgcgccgcctgacggtcctgaacatcgccgggctcggacagtcgcgcccgcaccggcaagggcacgccgctgcccgggtggtgaagaccccggcgatgcccgccggacggagccggatacgacgtccggcccgtgtcgaggatgacgccacctggcggcgaccggcttttggcgggaacgtattctcgctgttcatgacgtcgcggagtcggttgtggggtgtgtcctcctgggtggcatgggcgaggggtgctgcggcgccgtggcaccaagcggcgatcgaggatgcccaccgcctcgtgtgggagggctcgttcgaggcggcggaggcacgggcgcggactgtcgtcgccgctcgtgagggtgtgcgggggcgtgatcggcggccatgggtcgtttggacgggcaggtactccgcccttcaggcggcggtccttcacggccgcggggcggtggtgctggctgaactcgaagacttgatcgccggttcggagcacctggccggcgcgagccggcggatgctgctgcgggtcaggctgttccgtgcgtgggtgctgatcgacgagggccggcccgctgaggcggaggccgaggtcgaggccgttctgcggacgctgacgcggaccatgtacgtgaccgaggtctgggagctggaactgagtgccctggtgtgcatgggcgatgtcctgtgcgcgctggaccggcacgaggaggcggagacgatcgcccgcgcgcatctgccgcgggccgagggacacctggcgttcgctctgcaactcctgttgcttcacagcctgtcgggccaggggcgtcatcacgaggcactggacgagtccggcaggcaccaccccgagtcggctcccgccgactcgggagcgcacgagctcgccgctgccgtcgccctgaacggcctgggccgccacgacgaggcgagaagagaggcccagcgggcactgaccgcatgcgaacgccacctccaccccagccaccaacgggtgcgcaagatccgggcactgctcgcgctcatagcccccgcctgacatgacagacgcgcggcgcgcaagccaggcgcggtcgacgcgcgacacacggctgcagccccggaggtcaccagcacccgccccgctgccagaaggcacccgggcgcgtacgcagccggggtggtgtccggggcccgccgtcccgggccggcggctgcctcgtagcggccgttgccacagtgggcgcggcggcctggttcaatgccgctcaggaatccgggaccaccacggacgcgctgtgcggccccaacctcggccgcgacgaggccgtcgcggcgcagcccaaggccgtggccttcgtcgaggccgtcgagaaggcctgaccgggccccagctgaacctttcgacaaccccctccccgagatcaccgtccgtatcggccgaccccgcacgcagaagcccgcactgtcctcccgggaccgcacacgctgccgccgccggcggcctcaccgagaactccgtacggagagggctttaccggccgttctacgaaaggcgacggctcatgacagagctggggcggctgtgagccgaccgaggttcgccagggagagtggcgaagaccttgcggtcctcccggcgtgcagggccgcgtccttccggagttccgcacgctccaccggagctcttgcacccgtatcgccgcccacgcctgacattccccggcgcggctgacagcgccgccacagaccattccgcggggctttcgaggcggccggccccggccgcgccacggatcgtgcgacagggtcaggagaacgccgccgcttcatgtaccggcgcggggcgggcccggtccgcatgaccgaataccaccccattggcctgctggccgaatgtggagccgcagtgttgtcgaggaatcggcgccgggacatgatcacttctcgcacgacccgactatccatccggtgtcggcgcagaagaagtgaaatcccggccggtgtcggcttcttgccgctcccggacgcatcgagacaaaggtgggagcaaggggggcatgccggatccggcagctctcttctgccgtcgcgcagacgcttcgcgttgtctcatttcgcttttcaatgaaaggaattccaggctttcatgtacaaacgttcagggttcctcgccctcaccacggtgagcatcgtgctgtgcaccgcaggtctcgcgccgaccgtcagtcaggcagccgggggtaccggcgacgggaacggttcctatgccgacagcaacggcctgacagcggatgacgtcaggctcatcaacgcgctgaacgaagcgggcctggacctgggccggccgggcaaaacccccggcggggacctgccgagcgccaccgagtccctcagggcctccacagcggccggcgacagggtcacgccgcctgccgagccgctggaccgcatgcccgacgcgtaccgggcccatggagacagggccactaccggcatcagcaactacatacgcaagtggcagcaggtctacagccaccgcgacggacgagtgcagcagatgaccgaacagcagcgggagcagctgtcctatgggtgcgtcggcgtcacctgggtcaattcaggtccttatccgaccaacaaactggcctttgcgtccttcgacgaggagaagcaccggaacgctctggagaacaccagcccgcggccgggcgagacgcgggcggagttcgaggggcgcatcgccaagcagagttttgacgagacaaagggattcaaccgggcccgggatgtggcatccgtcatgaacaaggccctggaaagcagccatgacgagagtgcctacctgagcaacctcaaggcagagctcgcgaagaacgacgacgctctcgccgccgaagacagccgttcgaacttctactcggccctgaggaacaccccgtcgttcaaggacaggaacgggggcaaccacgacccgtccaagatgaaggcggtcatctactcgaagcacttctggagcgggcaggacccctcgagcccctccgacaagcggaagtacggggaccccggtgccttccgccccaaccagaacacaggcctcgtagacatgtcgaaggacaggaacagctcacgcagccccgccaagcccggcgaaagctatgtcaacttcgactacggctggttcggggaccaaaaagaaacaaaccctgacaacaccatatggacccacgccaaccactaccactcgcccgaaggtggtatggggcccatgcaggtatatgagagcaagttccgcaactggtcctccggatacacggacttcgaccgcggaacctacgtcatcaccttcatacccaagagctggaacaccgcgcccgccaaagtgaagcagggctggccgtaacaactcgccgcctcgcgagcgcaattccgcgcagccaccgccgcacggcgcgggggtcgcccctcggccacgcccggtaggagtcctccgcgccggcctcgggccggggtccggcggggcggccctgacgagtcgacaggatcacgactccgtatccgatcaggaaacggaagggaagagtcccttttgtgactccaggagccggtagcgtacgcccgttcgatcatgcccacgtccccaaggaaccctccatggccacgcctcccgcgccgcagtcccctgagcagcccgccgctcccggcccgttcgacgcccccgtcgcgccgtccgagcccgcgaagaagaagagcggcctggggaagaagatcctcggcgtcgccgtggcgatcgcggtcgcactgttctggcgtctgggccttccccatctgacaggcgatgccccggtgcacgcggaggccggggactgcgtcgtcgtcaccggcccggagaacgaccccaaggtcgagagcaagggctgcacggagaaggtggccgacctctacaaggtcgtcaaggtcgtcgacaacaccttcgacctcgacaagtgcgagggcgtggccgaggtcgctctcgcgcagcagctcgagacggacaagttcgtcctctgcatggagcccgtcaagaactgacgccccacgcacggccgcaggggccggacccgccgggtccggcccctgcgacgtcctcgcgggccgtcaggcggtccgcccgcgcccgggactgccaggtgcgaaggggagcggtggtggcacgggatggtcggtcggccagagcggggcggctgttcctgcccgcactgcggatccgtccgccggcgggatcgatcacccgcgccgggccttggccgcccgcgagacgggcatcgacggggaggcgtgacgaggtgcccgccggcgccggaccgcagcgctgaaacgggatcctcagttccagtcaagcgtgcgccacgggctggccgggtccgcggtcagggcacggtgggtcgcaaggaccgtctcgtaccactcgccgaactcctcctcgtcgaagtggaggcagcggcccaggatgtaggcggccgagaagtcctcccacgagcggtagttgagctgcacgagacggccggcctggaccacggccgcctccgcctcctgcagggagcacagacgggcggcgagtccccagcgggccatgccggaggcccggccgtagtcccaggcttcgacgctccggacgaagccccccgcgggcagcaggccgtcggcgcggaaccgcgcctcgtagcgtgcgatgcggccgatcaaccgctgaaggccggtcacctggccctccagctccgcagcggtgaccgtacggcccggggtgacgccgtccggggtcaggtgaggttcggcggcggcctcggcgcgcctgcgcaccgcgttccccgcggcctcgcgccagtggtcgacgtcgacggggcccgcgaagtccagggccatgccgcgccgaagctgcagggcggactcccagaccccgctgaccattccggcgcgcagcaactgagcctgcgtgccctgccagtcctcccgggtggtgacgccccaccagcgttccagcatgcgcttctcgtcgcggtagccgcagccgtggtaggccatcgagttccagtagcgcccgttgtgcacgttgatgtgcgcgccggccgcgagaccgaaggcgacggggccggtgagggggccgcccacctccagggtgtggacgacgtcctgggccagtcccggccgttcgaccggggcggagtgacgctgccacagggcgaggccctccggcccggccggcaggacgcccttgcagggactgccggggttgacgacgaggtagggcgggtcgttctggttccagacctccgcgaaccagcccaggtcgtagcagttgtagaccgggtcggcgacgggcggcggcagcatgccgccggtgtagacggccaggcacgcggtccgggtctgcgggttccagtaggggtggaagcgggtgctgcccccgctcgcgtcgacgtaggcgcgcgactgcatcatgtacaggtcggcccgtgcgacgaggtcgtagtacgcaggccagtcgccgcgcgccttcgcctcgtacagcccccgctcgaccgcgctcggcgcctgccagccccgcgccgatgccgccggaccgggcagggctccttcctcgtgacccgctgtcaaactcatgggtaaaccctaaaggctggtccagtgcggtcggcgtgccggtcccgccgggcgggggtcgaccggggcgagcctttgccgagcgcactacccgggcgcttgacccgccaggaggcggaccgggagcggtcgctgcgcccgctgaaggcgttcgacgaggatgctgacgacggactgccggggaagctgccggagttcgagggatcgtccaccacggcgtcgccgggcccctgggcgggcgggtgtgggccgggcccttcccggcgcgcggcaacatgggcaccgccgtcggccgggatgcatacggcaacccgttcgtcatcggtgatctccacggtacggagcaacgatcgcagctcttcggaggctctccttgactgccgttacgcgggaaatcgattcacggctcaaagcggcgagatcctggcggaggtcagcgcgtcttgtgaaaggcgtctgcgcaggtcatggaggagtaggcgccgggctgactcgctccgatcaccccccaacaaggtgctcggctcctcctcggcccgtccaattctttgatgccatcaactgccccactcgatggcgcaggctgtgatcgagttgcccagacggacggcagcttgaagacttgacatagcagacgtcgcgctgaatcagccgtgtctgcgcaaggctctctcgctacttcgacgcgggctcccacgaccatcgagttccgcgatggcgaggcagcggccacgtatccacgcctcgaccgcgcgccggtccggtcgtcagccctgaggcgaagacaacttgcgggggtgtcccgcaggcagccgcgcacggtcatggttcctacacgagggagcgccaccatgacggacatgcgtgaggagaaccagaccagtgatctggggctcgcggacatggtcagcgggctgcgccgtgagctggaagtcgcacagcagcgagcgctggcggaggagctgaagttcagcgtcgaagacgtcgaaatcgaagcctccgtccaggtgacgaagagtggcgggggcaaggccggagtgcagttctgggtggttcaggccggtggggagttcgcgcggagcaacgcctccactcaccgcatcaagctgaacctcaggctgcccgagaccacgcacatcggcgactcaaacaaggatccgaaatgaccgggctggacgccgaacgcctggtttctctttcagccgacgaacgcggctcaggctatctgctgacgccggatctcgtgctcacggcgggccactgtgtggggatgagggactccacggccacggtgcgcaagtacgttcgccgtggcgggggttatgacctctcggatgagccgcatacgttcacggtcgtggccaaaggcacccaggacaccgactttgcgctcctgacctccaccaccgccgatccgttcgggaccgggagcttggacaggtacgtagaggtgcggctgggccgcttggtcggcgaggaggcggttccggcacagacgctgggctttccgcgttcgcagctgtacgaggccggaacggagcagttcctgaacgtggaggacgcgaggggggccatccttccccggacgggtgcgcggcacttggtgcagcaggtgaacttccagatccagagcgggtctccgcgggcaggccgtggcgcgtcatggtggagcggaatgtctggcgccgctctgttcagcggggaccacctcgtgggcgtgatcacggatgaccgggccagggtcgacggacggttgcatgccctcccggtcagccggattttcggtgacgacggctccgaggaggcgaaggcctgcctgctggccgccaggagcctcccggccgacgctaccgtcctgctggaccccgtctgggcgggtggcgaggtcctgcagccggcctacagccctttgccgctacgcgatctccggtccgaggcggccctactcgaggcccggtacgaagtcgtgccgttcacgggccgggcgcaggagctcagcgccctggtcgactggtgtcaacaggctgatgggcggcgcatgcggctgatcaccgggggcggaaccgtcgggaagacccgtctcgctcgtgagctgtgccgccggatggccaggaagcactgggtcaccgggttcgtcgatccgctgtgtgccgacttctccaacgtctgcgacctggcggagaaacgactgttggtcattgacgacgccgatgcccgcgcgggtcagttggaggcccttctcaccacagccgccgagcacccagcccggcattccctgcgcatcctggccgtcgcccacaacggcggactgtggtgggatgcgttcaggcggcggttcgagtcactggccgacgttgaggacgtgctgtcgatcgagcccctgcccgaggccgggcgtgaagacgtctacctcgcggctctcgcggccttcagcaagctgtacgagcagaaccaggggacgggcacggggcgacaggaccgtgccgtgccagacggtgcggtcctgggagcggagggagagccacgtcccggggcgggcatacccgcactcggcgaggccgacttcggcagcttcttgctcatcctgatccaggccttggtggacgcgcgggccggccttgacaaggcgccttcggccttggcgggcccgccctcacgctcacggtccgacgccttgctcgactacgccattgacgtggagcgtcaaaggtgggtggtatcggcggaagggcagaaactgccgagtgacccggtcctgctcgaacggatcgtcgccgtctcgagcctggccgtggccgggggccagtcggatggagagaaggaaacggaagcagcccgtcggctcctgctcgttcccgacctcgcgggcgagccggaatggctcaggcgcgcgttcgcccgctggcagcacacggcgttcgtcggggacggctacatgcgctcgctgcagccgcaacggcttgccgagcggctcggagccaaggtcatcgcgacttttcccgatctcgcctccaagctgctcgatgtcgccggaggcgggccgggcgtcccccaacacgagatcgaccaggcgcgccagattctcaatgtgctccatgtcctgcagctcaccgccggatccggtgagtctccttcgggtgacatggtggcgcccgttgacgccatggctgggccgactgcacagcagacggcgcgcgaaaggttggaggaggctctgcgcgcccatgccgtcccgctcgtcagactggtgaaccagctcgctttgacgaaagagattcagttcgcgagcgccatgggtacgtcgcttgctgccgcgttgaactccacgctgggggaggactcggcccaggaggtcgccgcccaggttctgccggaattcgacgagtctccgccggatgtcgtcctgaagctggccacggccatcgcacaacacgcggtgcagtaccaccagcgcgacgggacgccggccactcaggagaatcgaaggagcctggcccgggcccagcaacggtggtcgctctacctggccagctcagggatgcgcaaccgggcgcgcgaggttgcgggccaagcggtcgacacctaccacgcgctgcaacaactgatgccgtccgaggagcatgacttgtgtctggcagaggctatgcggaacctggcggacagactcttcgacatcggacgcttcgaggatgccgacagctgtgccggtgaggcgatacgtcgcctggagacgttgttccagagcaacgccacccggcgacacgcgttcgctctggtgacggccttgtgcacccgggccacggcggcccaccacatcggtcgccagcgagaggctatgcaagcggctacagcggcgtgcgagctgatcgaggcgctgccggcagcctctgacggcgaggaggacaaacccgacgacgtcctcggcatgaaagcgggtgtgctgcggtgccgggcctggcaactcggcgcgaagggggacgtcgatcaagcgctggagaaggctgccgagagcgttcggatctacgaggatctacgctcgcgcactcccggccgttggaagcgggacattgccgaagccctcaacgtgctcggcacccagcacgccgccaagcagcagtggggcgaatgcatcgaccggcacagaagggccgtggaggactactacaaccccctggaacgggagtaccgcgaagcggtccggccccagcacgcactcgcgctgcggcggctggcgtacgggtacctgggaagagcccggtcccagccgccgccggagagcaggctggaagatcttcacaaggcgctgcagaacgtcgagctggcattgcagcagtacgaacggatgtgcaaagaggacaggtgggcgaagcgtatccacgaggcgtcagcgcgctgcctgacggcggaaattctgctcgacctcagtgacaccgaccggcatccgcgcgctgccgccgcctctcggcagaacctcgaacgggctggggaagctgcccgtcagtcgctggacctgtacgacgagatagacccacgtgcctggaagctcaggctggacagggcgcacgcgcaagcggttctcgccacatcgttcgcatgtcaagggttcccccgggctgaggttctggcggcctacaaggaggccagacaggcattcgcccggctggatgcggaggagccgggacgggtggaggaggaactgcgccacatcgaggacgtgatcaaggagttcgcacagggcgcgccgccccatgtccaccagcctcgtccgcgagtcgtcgcgagccggccggtcagacggcggaagcgccaacagacggtgtctcatttgcggcaccttcgcgatgcccgccggtgaggtcaacgggcccgtgcggccgtccgctgcccgtccgtcaccgggatgtcgagccctcgtcgccgtgaggacctcgtacgaggtggacgagccgagcgcgaatgcggcgcagagtcggatcggacatcacgaaggtgaacccagcctcgtggggctgtcggccgcgggcaggcccggcagccgtcacacgtcgccgacaccaccggtcggcagcatccagcactctcacccctgctccggcctctgcccgccccgtacgtcgatgccggacgggcccggcccaaggtcctctcggggatggcactttcaccggacgcaggcgcgcggccggacagctgcggcacgctggaatccggccgggctcctgcccccccccccgcaccagccgccgggcgatcgccccgagagcgtgctgcgacccggccgggtgcgggtcggcgtcagtcgatgtcgtccgggtcgtagacgtccttgtcggccgggacgtccacctgtacgggccggttgatgccggtgaaggcgagatcgaacgcgtccgagccgccggtggtcgccttgagcagaaacggttcacccttggtggccaccaggaagaccccttgcatcgtgttgagcgagagcgcctcctggccgtcgatctcggtcagcgcgcccttctccgcgtccctgatgctgtacaagtccctgagcaggccgtcccggtcgcacaggctggtcaatcccttcatggaggggtccgaagtctccacgcgcatccagcggcccgacatctccttgcgggctcgggccgcctgttcctcgggcatgtcctgcgtccgggcgaggacgagggcctcgtcaccacggaagaacgtgtgatcccgggtacggaccacttcgatgttgccgccgctctgggccgacagggtgcccgtgcattcgccggacccgctgatcgacaggttcacctgcgtgggtacgcccaggccggacgtcgtcccgctgacggtgaacgtggacgcgccgcgcagcgcggtcacggagtcgttcagcactcgggagcccggccggccggggaagggttcggacggcaggcatccggtgagcccgagggccacggtgccggcgagggcgacggaggcgatcaagcggtgagcggtgcgcacggagactctcttcaacgggggcggttcggaaggagagtacggggcacccgggcggcagccccagcgggggtggtcacatcaactggacgggggatcgcggtgggggtcggtcgctgcgcccgctgaaggcgatcgacgaagccagccgttgtcagtggtgggcgcgaggatgcgggcataccaccgaaccagccactgtctgaaggattctccatgtccgttcctgtctccgggcccgcagccgacgtcgcggccatccccttccccaccggctggtgcgccacggacctgggcagcttgaggccgtgcgcgtccacctacgaggtgtaccccgtggagagcctgccgcctctggaggccgcgcacctcgatgacgggttcgactggctgggcggggcgggcgggccgcgatccgagcacacggagcatctcgcggccatggagcaggaactggccgaggccggactggcgctccccgcgggcttcgccgccttctacggcagcgagcacctctgccgcgttttcgacgaggtctcggtgacggcctgctggagccacctttccggtccgctgcccagcccggccgaggagggcgcccgtctcgtacggttcctgcgcgaccagcaggactgcgtcatctggtacctgtacctgcggccctccggcgaggcgttcgtggtcttctcgcatgtcgaactggagtccgccggatggtgggcggagggggagccgaccgaggaggtccgggccgcggtggccgcctcgctgatgcggtgcgccgacaccttcgaggagttcgcgtaccgcttcgtcgtggagaacgagctgtggatgcaggcgaattccgcaggcgccgagagccggctcgcgccccgcctccaggcgtacgccgaccactacgcgtccgccgcaccctgagccggtcgcggcgggccttctggctgaccttctggccgcccttcctgaaactcacttccaaagccaggcgtactgcggccgtctccggcttgggctcgtcatccgcgcctacgacgccggagaccactccaacgccaccggccggcaagcctggatggcgcccgtgttccgagctgcgcgaggttgttgcggctgacgagggtgtcggggtggtcggggccgaggacgcgttcgcgatcggcgagggtctgccggtgaagctcggcagcctcccggcgacggccgaggtccagcagggcgacggcgaggttgttgcggctttcgagagtgtgggggtggtcggtgccgagagcgcgttcgcggtgggcgaggttgtgccggtggaggtcggcggcctcctgatgccggtcgagatcctgcagcgcgacggcgaggttgttgcggcttccgagggtgttggggtggtcgttgccgagggtgcgcacgcggtcggtcagggtgtgccggtggaggtcggcggcctcctggtgtcgaccgagaccctgcagggtgttggcgaggttgtagcggcttccgagtgtgagggggtggtcggtgccgagcgcgcgttcgaggcgggcgaggttgtgctcgtggaggtcggccgcttcctgaggccggccgagaccccgcagcgcgagggcgaggttgttgcggctggagaaggtgtccgggtggtcggtgccgagggcgcgttctcggtcggtgagggtctgctggtggaggtcggcggcttcctggtggcggccgaggccctgcagcgtgagggcgaggttgttgcggcaggtgagcgtgtgggggtggccgttgccgaggctgcgttcgaggtgggcgaggttgtgctggtggaggtcggcggcctcctggtggcggccgagaccctccaacgcgagggcgaggttgttgcggctgctcaggacggtggtgtgatcgttccccagccccggctggaggcggttgagggcttgttccgcaaggacagctgcctgttcgggatgcccggctcggcgagtactgtccgagagcctgccgagggtgcggccggcagccagggcgtcaggggtgagctccgcgatggtcagcgcgtggggggcgagaagtctgctgatggtccagccggacaggctggcgtctgcggcttcgtccacgacggctgccatgcgttcggtcagggcccggtgccagctgtccaggccgggggtttcggcgcggagggtgagggcggtgatgtcgcggacgagcgggtggaggatgacctgtccgatggccggcgtgccgtcaggaaaggtgagggtgtccaggagaccgtaggtgtggagtccgttcaccgcggtctcgatcgctaccgcggtagccggtgtcccgcaggcggcggtgaccagctccgggcacaggaaggagactggtacgggcgcgggcgccagcagcgacaggaggcgcagtaccggccgggcgagcgcgttgccgttggcggcgagttggtcgagggagagctcccaggtgtagcggaccaggcggcgcgcggcctcgggatcggccccgcccgggatctctgccccgagcagggtggccaggtgggtgccgagggcgtcttcgtaggcggtgaaggtgcggtagcggctgcccggcgcggcgaggtaccggccggcggcgtgcagggcgagggggagcccgccgagccggacggagaggagttcggcctcctgcgcggttccggccgcaggcgcggcgtcgacgagcacctgcccagccgccgacggggtcagcggcgcgacgcgcaacagctcggcccgacctccccacacggaagcgtcaccgtcccgactggtcacgaccagcagaccgcggctgccgggccgcacccatccccggtagcccgccaccggctcaccctcgggtcccacctcacccggttcgtcgacgttgtccagcaccaccagccacctgcccacccggttcagctgctcccacaccacatcgggcagggccgcgcgcccggcccgggcttcctccaaccgctcctcgggaagtccgcactccagggcgatgcgggtcatctgctcggccagttcggcctgaccacgccagcgcacccagaacacccgtacgttttcggcgcgggcgatgtcggccagggcggaggcgatcgtcgtcttgcccaccccgccgacaccgcacagcaccgccaaccgctcctcgggccgcttcagcatccttcgcagcgcggcgagctcgtccgtgcgcccgcggaccggtcccgccccgtggggggccgacagggattccattccgccggccaggacccgctccagcgggaccagccggaccggccccgccccgcccccgccgtccaggcggcggcccagcacggccagcgtggccgcgacgatcacggacacgatgaagaccggccacaccacccacgggtcctcggcccatcccggcagcacatccgtcacgtagttcgtcaccacggcagacgccgcggcggccaccgccgcagaggccgcaaccaccgaacccgcccacgcaccccttgcccgcacactgcccccagcctcgccccacccgccggaggacgagcgtagaagaggggctgtgaccgcatcggccgaatcagcggactaccgaggagtaccgggcgggtttcggaccggatcggcgggcacgcgggggctgtcggtgtgtggcgtgacgatgggtgtcgtggtttggcaggagacagcgtgaaggccccgaggctgcctcggggccttcacacacttcgctgaccgcaggactcaacgaacgagacgggcgagagtcacgccccgcccgtcaccggttcaccccgcgccgccctccgggtcggtacggcccccgttgcggcggcgccagaacgggtgctcaggccaccgccgctcctgcgcgtaggaccgggcgtgatggtggtggtacgcgtcggccacgccgtccaggaacgaggcataggacgcgagcgcctccttctcgccggccaggcaccgggcgacggccgctccggcgcgggccccggtgtgcagggccgtgaggatgccctgggaggacagggggtcgaaggcgatcgcggcgtccccggcggcgacccagcccgggccgcccggcggcgacagccgcagtccgtgggcggccgtccagtacgggacgggggagcaggccgggtcgtagccgcgcaggcggtcccgtacgtgccgggtgcgcgccaccgcgtaccggaacccttcggcggtgcgcagccgggcaccggcgaggtcggcgtcggtgagatgggcgaccacccgcccggccgggaccctggcggtgtaccaccagccctcgggcacggcctcgacgagggtacgcagctccgggtccccggcgtggccgccgctcacccggccgccgagcagcgtgaacgcggccacgagccggtcctgtcggcgccgcagggccagacggcggccgatgagggcgcggcggcccgtcgcgtccacgacccagcgggagcacaactcccgtacggcgccgccccgctcccgtaccagcaggcgctgctcgccgcccgcgctgcggtggccgatcacgaccgcccgccggatcagcgcgcccgcggccaccgcggcctcgcgcaggaaggcgtcgaaccggtcccggtcgaggtgccagccgtgcccgtgcgggtcgaacaggtggctgtggccgagcagccgggcggatccccaggacgcgtcggtgcccgggcagctcaggtgtgcgtcggcggcgaaggcggtccagagccccaggtcgtgcagcagcggccgggccgcgggcggcagggtctccccgatggtgaaggcaccggagcgagcgcccggcgggcccccgtccaccagcagcacatgtcggccggcgcgggccaggaccagagcggcgacggccccggcggggccgcccccggccacgacggcctcgaggcgcccggtgcggggaccggcgccggtccgggcggtcacggtgtctccgggaagcgggcgaccttttcgaagtaccccgccagcacctcctcgtcgggccggtcggccgcggcgatggcggcggccaccgcctcctcccgcacgtcgggatcggcggcctcgggcacgtgcaggcacacgaggttccgcagcgggggcggagcctcttcgggatggaaccccacctcggactccaccagcatgctcgcggggagactcaccacgtcaccggagccggtatccgtgtccctatcggtgtccctatccgtatccgtatccgcggtggggacttcacgccgtgcgatgatgccgagcttgccgaagtccttgaccatggcgttcatctgggcgatgcggtcggagggcagccatctgtcccacaccgccctgtcctcgaaggcggtgcgacgctcctcggggtcggcggcgggatcgacggcggtccggtagttctcctccgtcagcacgtggttgggcacccgcgcaggccagaaggtgggcaggtacgggtcgtaccgcggcccgaagcccaggtagtacccggagcggcagcgggcggtgtcggtctgccaggggacggccatccagcgggtcagaccgcccggctcctgggcgtacagcggaccgtcgatcgcgagcaccgcctgcggggtgagcgtggagccgtaaccgggttcgggccgggcggggtcgcggtggcgcacccggaagggcgcggagtacaaggtggcgtgacgcatcggccaggagagctcacagccggggtggaaggcgtcggccagacagtacgacagggcggcccggtccagggccgccgggcgctgagcgagcggcaggccgtccagcgcggtggaacccggggccgccgtgggcggcgtggccgcgggatcatggtcggcgtcgaagtccccggcggcccagcgcgccagcatgccgtactgcaacggggagagcgccaggtgctggcgctcggagaccggccgcacgctcatcgagtcgccgtagatcggcggccagggcacgggggagagcccgtcgcgctcgggatcccgcagcatcgcccagatctgctgccgcagttcgtcgcgccgcgtaccgtgaccggccagctccgccagtcgcccgggtgccaggaagtgctcgcgcccaccgtgaccgaacagggccgcgaagccgcggttgacccactgcagatcgcacaggcggcgcagcaccggcagcacgtcgtgggtgaacgagacccgctccggcggcgccagcatgcccgcggccacgaaggtgtcgcacatcaggtcgtacatcgtgcgcaccgaggtgagctccggtgcgaaattcgggggagcgaccaccacccaggccggatcgaccgggacgctcctgccgtcgatgcggacctgcgcggtgaccggcccgtcgcaggtgtcgtcgtgccagccgtcgttgttggcgaagtgcgtcgcctggaccggggggtacgaggcggacaccccgcgcccgccgaggaacagcaggcggccggcttcgtcggtgcgcagttcgcccaggtagacgggatgcccgaggaacgtccccgtgtcgaacgcgtactcgggcttccccgcgcgctcgcggccccggatcgagcggggaccgggccggatcgccagccggtcgcgctccccggcgggcaccgtcgtgaggttgcgcagcgtggtggcgggcgcctgcgccgcctcggggatgtccagggccagctggaactggtaccaggccgccttcttgttggccacctccacggtccagcgcaggtcggcgttgtccgccgtcagctcggccaccgcctcaccggcggcgttgtagccgtacacccggaaccggaccgcctgtcgcttcagcgcgccgctcgcgtccttgtacgtaccggtggccggtgggggagccccgtcgacctccggggcgaggaagaactcctccgcgctgtcgccgacccgcgccaccccgatcgccgggtgcaccgcggcccgtacgatccgggtgtcgcgtccgtgcggttcggcggccgacggccgcgcgggaccgggctccgccgccggaatgccgttggcgtcgcgccgccgggccgccgacgcgcggtagacgaccttgcgggcctcggccatgctgccgacgggctcgtgctcggacaggctgtgccaggggttgaaggcgaggttgtccccgtactcctcctgcccccgtgccgccgtgtcctgctgatgcagagtcagccgcgccactctcacgggcgcgctctcgctctcctcccagcgcacggtggcccggtccagcggcatacggtccggatccgtccggaactggagcagcaggtcgaaggcggccgggccggcggccagccggtggcgcaggtccccgcgcaggaaggaggggtcctcgtccggcggcaccgcccgggggtcgccgtccgcgcagccggccgggacgagcttgtacttcacgtgccggtccggcccgaaggcgtatggcagcacgccccagtacgtcgacgtgagcgtgctctcgacgggcttgcgcatgtccgcgaggatctgccgggtgagggggtgctgctgctggtacgccgcctggtccagctggaactcgcacatgtcccgggccgtgtcgacgaagaagacgtcgtggttctgcaggacgaggtcctgtgtgtcggcccgggtgtcgtcctggagcagtttcggccccggcacgccgaacagcttgatgccccatccgacggttctgcgcaggtcgggccgctcgggctgggtatcgctggagacgcgcacccaggcggtcaggccgccttgttcggccgcggccctgaggaaaccgacgcagagctccgggggcaggtcgggggcgaccgtcagtacaccgcgggccgcgccgtggaacttgacgaagaccgggcgcaggagggggtcctgcccccgtgcgacgcggtcccccatccgctcgcccacgaactcggccgtgatcccggcgatcggctcgtcggcgcagtcgcgcgggggcggctgcgcggggctgtcggacacctcggggctctccgccatggctctgctcctgcctgtcgaggaccggccggggccgaccgtgtgctgacgctcctggcgggaaccagcctgccccacaaaacacccgataaaggggcaacccgcgcagacgtcggccgctacccggccgccacgcggcggcgttgtcacattcggagcgtccctccggtctcccgtgcgaagcgactgacgaagggaacgcccatgaagaccctgctcgtgtgcacgtcggtatcccacggcaacacccgtcgtgtggcgcaggcgatggccgaggtgctcgatgcccgggtggtcgcaccggacgaagtggaggcgtcggatctggcgggctacgacctcgtgggattcggctccggcgtcttcgcgcagcggatgcaccgcgacctgctcgggttcgtccggaccgtgccgcggtcggggccgtccccggcgtcgaccgcggtccgcgctttcgtgttcgccacgagcggcctgccggagccggcgttcgcaccgttcacccgtccgctggtacgcctgctcgaaggaaggggcttcgaggtggcgggcaccttcacctgccgcgcgctcgacacgtggctgccgttccggctgatcggcggcatcaacaggcggcgtcccgacgcggacgacttgggcgccgcccgggccttcgcccgacggctcacgaacgaccccgcggccgcaggggaccggtccaggggaacggatcggtgatcgcattgtcaaggccgaccggggaaggagcggcgagacccggcgtttttgtccgaggggcagaagccttccccagagcagtgccgtgcgcggtagcctccgcaagaggggtgcgcttcggaaaaacttttccgaaagtgagtgtccggagcgcgccacacccgaaatcaaccggtattcgcggactcgcggacaccatggacctgccgtcgtccgcgcaccgcaccgcgcactccctggagggacacacgtgaaggactcgaaggacaggctggaagcactgcgggccgagatcgagcgccgcaatcccgcacagcccgagttccaccaggcggtacgggaggtccttgagaccctggctcccgtcttcaccgcccggcctgagtacgccgacccggccgtcgccctggtggagcgcctcaccgagcccgaacggcagatcaccttccgcgtcccgtggcaggacgaccggggccgtgtccaggtcaaccgcggctaccgcgtcgagttcaacagcgccctcggcccgtacaagggcggtctgcgcttccacccgtcggtggacatcggcgtggtgaagttcctcggcttcgagcagatcttcaagaacgccctgaccggcctcgggatcggcggcggcaagggcggcagcgacttcgacccgcacggcaggtcggacgccgaggtcatgcgcttctgccagtccttcatgaccgagctgcaccgccacatcggcgagcacaccgacgtgcccgccggcgacatcggcgtaggcggccgcgagatcggctacctcttcggccagtaccggcgcatcaccaaccgctgggaggccggcgtcctgaccggcaagggacagggctggggcggttccgcgatccggccgcaggccaccggctacggcagcgtgctgttcgccgccgagatgctgcacgtccgcggcgaatccctcgacggcctgaccgcggtcgtctccggctccggaaacgtcgccctctacaccgtcgagaagcttcagcagctcggcgcgaacccgctgacctgctcggactcccacggctacgtcgtcgacgacaagggcatcgacctcgcacttctcaagcagatcaaggaggtcgagcgcgggcgcgtcagcgagtacgcggcgcgccgcggatcctcggcgcggttcgtcccgggcgggcgggtctgggaggtccccgcggacgtggccttcccctccgcgacgcagaacgaactcgacgcgcaggacgcccgcacgctcatcggaaacggcgtcaaggcggtctccgaaggcgccaacatgccgaccactcccgaggccgtacggatcctgcaggaggccggggtcgcgttcgggcccggcaaggccgccaacgcgggcggggtagcggtcagcgccctggagatgagccagaacgcaggccgggtggcatggagcgcgcagcgggtggaggacgagctcgccgccatcatgcgctcgatccacgcggtcgcgcacgagaccgcggaacggtacggcgccccgggcgactacgtcaccggcgcgaacatcgcaggcttcgaacgggtcgcggacgcgatgctggcgcagggcgtcatctgatccgacggtcacaccacgctcggccgagccgggcggtccccgctgcgctcgtggaaggtgccccgccggaaccggcggggcacccgcgggcggcgggtgaggccgatgggcagccggcaccgcggacagggcgccgtccggcctgcccggcgcccctgccgcgccggcacgccggtgcagtgcctcggcgtggggttcgcgcggtgtggcgttcgcgcttcacgggagcaggggacgtccctcctgcgcagccttgatgtgctcggcccggagcgccccttccccgtgctcggcgacgaacgcgcgcacacgcccgaggggtgagtcgtgcgggggtgcctcctcgctcaccgtaccgccgaggatcaccgcgccgaaggccgcgcctacgtcctgccgatcgttcaggtccatgtacggacggtacgtcaagggtctgacagtggaccgaccggcgtcagcccactgcgacgaccgtcacacggcaccgcccgcgcaggcggtcacctcagggcgaagagcatgttggccgagttgtagtaattgggcaggtggaccatgtccgatcccggacgcggcgggtcggccttcggccagttccgcgggcccagcagatggttggcgtagtcgctgtgccagaccttcggcacgaaccagacgcggtacgcgccggttcgtgcctccggctcgaaccgccagagttgcgtcatgcggtccgcgccggtccggcaggcgcgcagggtcacctgtacgacattcccgccgccggtggttccgtccaggcaggtgccggtgtccgcgttgcggagttggtaggtgttctgaagggcagggatccgctgccatccctgtcgggactttccggtgcacttctccagctgcaacgggccgtcggaaccggcgccgccgagacccacgcacagtcccgaggccaggttgaccagggcggagccggtgccttccgtcgagggcgacacggagggcgacacggagggcggcacggcggaggccgagacggacgtggaggcggaaggcagtgatgtggccggggccgtggcgaaggccgccgggccgatggcgacgatcggtgcggtctccggaagtgggccctccggggccgcggaggtactggcgggagccgccacctggccggacctgccgctctcggagtcggccggcagcaggacgaccacggtggccgccgttccgaccacggctgccgtagcggcccatttcacggcgccgaccttcgatccgacgagctgcgtcccgttcagcgtgccggcggcgagctggatgccgcccccgcccagggcctccaggaaggaggcagggttccacagcaggatgccacccagcagcagcacgcccagacggccgttgacatcgcgcaggtcgcgctcggcccgggcgcagtcgtcgcacccctggaggtggcggttcaggtcccgggtgaggcgcgtgcgcggtcggcgcagcctggcggcgatctgccctccgtagtacttgcactcgtcgctcgcggtctggtccaggtgcgcgcgcaggtacgcctcccgcaagccttcccgcgcacgcgcgaccagtgatccgacgccacccgccgaaatccccaggcgtgccgccgtttcggccgccggttcgtgttcgacgacggagtgccacagcacggcctgccagcgttccggcagggaccggtaggcgcgcaggaccagcgacccctcctccgcggagaagacggcgtcctcggtgtcctggccgtccgagagttgggcggcccattcctcgaagtcgtcggacagccgtgtacgggaggcttcccgcgcccatgtggccgccaggcggcgcacgcaggtcagcaggtacggccgccaggcgtactcgggcccggccccccaggcgatggcacggtaggtacgggcgaaggcctcggcggcgagatcctgggcggtggacaggtcccggcagcaggtgcgcgcgtaggcgagcaccgagggatggtgacgggcgaacacctcgtccatcacgacgctggccgccgcgtcggactccgaggtgtgcccgcgcagcagggcacacagttccccgtcgctgaggtctcggagatgctgctgacgggcactacccggtgtactcaacacgtgctccagtgtggcttgctgatgacccgggtgttggttccgggtacatccgtcatgagggtgcgacgctgcgcccggccggaattcgcgcaagtgtgcacgcttgcggggccgcaagcaaacccggcacccccgcccagctgcgactcaccgccggactctgcccggccggcaccgaacggcagtggccgaatagcatcccggggacggaagtgccggcacagtccgccgggccgaggccgcgacatccgccaaggtcgtgcccgccggcgccccgtgcccgcacaggtccaccgggtcggggtgcagggatccggatccgccacgcgccctcggaaatccagtggtcgcgatggcttgaggtgagaagaatccctggtcatgaccctgctgacccactggccgcttgcgggcctgcgattgaccacgccgcgtctggagctgcggttgccgaacctggacgatctcgccgcgctggcttcgttggccgccgatggtgtacacgaccccgcggtgcagcccttcaccgcggcatggaccgacgccgagcccgaacagcgtgctcggagtgtcctgcagtaccactggagccgctggggcgagtggcggccggagaagtgggagctgaacctggtggccgtacgcgacgggaccgtcgtgggtacccagggcatcggtgccagggacttctcggtccgccgtgaagtcggcacgggctcctggctgggcagggcctaccaacggcagcgcctggggaccgagatgcgcgcggctgtcctccacctggccttcgccggacttggcgcgcagcatgctgtttctggtgcgtatgcggacaatgctgcctcgctggcggtttcgcgcaagctcggctatcgcgaggacggcatcgagcgtcatgtcgtacgctcccagcccgccgtgctgcacaggctccgcctcacggctgaacagtggcaacgacaccaactggtgcccgtgaaagtggaagggctgacgcagtgcctgccatgcttcggcctggcgtgagcgagcagcagcatggagtcgtgagccagatggcgggggttggcgttgtgccggcgcaggcaggcgtgcaaggcccgcgtccggcggtgcggttgcggtggtcggagtgggcgaaggtcaacagtccgcgcacgcgaacaggctcaaccaccaccccccccagcggccgcaacgtcgtgtgcggacatccgccccacggaacgtggtcgcccaacgccacgatgcctgcgacgggcctggcgcggggcgagtgggtgagggcggtgtcaggcgcccacagactgcgccgggctcgtgcatcgtgcacgccgaactcgcctgaacgggcgggccgccacccttgcccgccgacgaggcggccggaacatgcggctccgtcctgggcactgtcccgctcggccggatccccgccgccgcggctggctttgcacgacggatcgggttccggcacaactcctgtgggccggcacgtggatggtgcggctccagggagcccggcccccggaaccgggccgcagcgcggtcgggtcttcctcctccctgcgtgacctgatatgagttgatcatgaatgcggaagctcttgacgcgatggaacgccgacgaccgcggccggccgtgatcctcggatgatcagcccgagcacccggcgtgtggcgacggtctcggggtgatcggggccgtgaaccctggtctgaacgatgcatccgtggaggacacatgtggcgtgaaatcgtggagcagtacgacggcgtagatggagcggaccctgcgtccgagcaggacttgctcgacgcagaacgcatcctgggaacagcgttgccagccgacctgcggacactgcttcgtgaatccaacggtgtgatggacgcagacggcacggatatcgtctggagcgcagagcaagtcgcccggaccaaccaggagttccgaacgagggaggacgtgaagaacctgtacatgccgttcgatgccctcctcttcgtcggggacaacggcggtggagaccaattcgctcttccggttctgccgatgcgccccgatgtcttcgtttgggaccacgagaacgacagccggacctgggtggcgtcgagtctggcggagtaccttcgaaaggcgctggcgcaaccgggtgaggactggtaccgctgaccgaccggtcctcgatccagcaatgacagccagcctcgatgtccgggaagccgcaccgccaaggcgctacgcatgcgcctctgtcggatcaggcggcgattggtttgcggtagcggacgtactcgttctggcgccggaaccctacgctctcgtagaggtcgtaggaccggtgcggattcgcggtcccggtgtacaaacgagcggtctctgctccgtgttcgcgaagacatcgcaacccgtccagcagcagggcccgcccaagacccagacgcctcgactctgcccggacgctcaattcttctacttcgcccacagtggggtcctgccgacggatggagcacagggcgaccccggccaagtcttccccgtcccaaccagcccgccagcaggtcgggtcggcagtggcgaggaagctctcgaacgtccacctctcggtgaaggcggcatccgcatacgaatcgacgaccgtcttccaggccgcacggtagctgctcggatcgagcgcaccgactcggatgccggccggcaacggctcttcgtcggggagtcgtcggagatcggccaactccagctctaccaggctgaagacacgccggtatcccgattcgagcagcagcgccgttgcgtcctgttcagaggccatggcgttcgcgccgaacacagccgtccgtgtggttccatgctgctgcacgagccggcggatacggctttccgcccagttgagcatggctgagccgatgccctggccgcggtactcgggcagcaggtagccgcggtgcaggtacaaccacgttccgtctcgctcctgccaccacctgatcgtcgagtagccgacgacgccaccgtcgtgctccaccaagacctggttccgggatggggcatcgaggttggcggaggcttcggcgatctcggctgccgtcgggattccttccacaaccgagcgggcgtcgatccggtcccgctgcgcgcagccgagccgcacagtggccatcgcgtcatggtcgtcgtggccgcggtacggccggaagacgtagccaggcaaccgttcccacgatgcgaggccgctgccgctgttcacctccacatcaagacccccgttacgttggatcacggaagcgtaggcggtgccgatcacacggcagtacccgttttccgcagcatgtccgccgtccgtacgtgtcatgtcccagctggacatcgcgcgcggggtgggacgccctggccggggcggtgatcagcccggctgttcgacccggctccggcgctggcggcgctgctggggctcgggtggtggggttggaccggggaggctgagtcaggcgtagcggtggcgaggtgcgtgcgggtcgtcccagcggtcggcgtgggcgagaccgagcaggcgtacggcgtgccggagttcggcgggtgcgccggtggcgcggagacgggcgggggcctcgcacacgagccaggcggtcagttgagtccggacgtcttccacttcctcttgcgaccagacgaaccacgaccgccacgggagtgcgtcctccaggaggtcccactcccaccggtcgaccgtgtcggtgaggtgccggtcggcgaccgggtggcgcaggttcccccagaccgccagccaggggccgatgtcggcggaggcctcggcgcacagcgggaggagttcgtgcacggggacggcggggtccggggagaggagggcgtgggcccatgaggcgtgcaggaactcgcgtacggccgcgctctgcggcgcgggccactgctgccatgcggcgcggtggaacgagatgccgacgttgtcgatgtcgtacgcgtgggcgccgaggcccccggtcagttcgcgggcgaactgcggcaggacgcggcgcagcacggcgccgtggtcggcccagtcgggtgcgctccaggtgcggtgcaggaggtcggggttgagttccgtgtcggggagcttcagcagagcaagctcctccgggctgccccagtggcactcgcactggacctcgtcggcccgcgcggtcatcccgcggaaggtaacggccagccgttccactgcccggtcgagccgtacgcggtcggccggggcgggtccatggccggggtcgggtgtgggttcgcgttcagtcatggtcgctggtgcctcacggggactccgggcggccgctcgcgctcgaagagcgcgactctacccgtacgcggatcaggccgtgacgcgggggaccgtacgtccgtcgctgctccgcgtgcgatccatgaccaggacccggcggcatggatgccggctccggcggtgcactgccggtacgtcggtgggaggagagcgaccaatcaccggtggggtggggtctggcggtggaccaatccgaacagccgcagtcggtccggcccccaggccttctaccggcggctcggagaggagaccaacggcaccttccgggcccgcctggagagggttctggtcgaccgccggggccacgcgatggctttccacgccgcccaggcgactgcggcatcgagatccacgagagcctcttctccaccatcgtcggcggcaagatcacagacatcgaccagtgcagccaggacatcgacgagagcgacgtcttctggagctgagccccggacgcgtggggcccggggcggcacgtcgccccgggccccacgcacgtatcatcggccctccctccgcgcctggaagttctcctccaaacgccaccgcgtgtacacgaggtactgcgagaagcctcctgcgtccgtcggttcagccggtgatccggaccgactgagggccgccgatatgggcccgtccctcgccggggccgatcgtggtgacgcgggtcgcgcaggccgtgccgaggtagatggtcatccgcctgtccgtctcgttgacgatcagatctgcccggacctggagggcgagacagacgttgtccggtgggttgacgatccggaactcggcttggttgacgtcgaagtaccgaatagatcctgtggcggcctgcgcgttcgtggccgcacctgtggcgagcacggccgctacgccgacggtgaggccgatcctgcagaagcgtgagagcgcgtggcggatatgcatagaggcatccgttcctcatgggtgatgttcgggcgattccacgttcacacgtcagttctcatctcgacaccccattcactcggacgcggcaagggaaaacgttcaggcattcgcccattggggcggggagtatcaatcccggtccgagagatgcccttcattcctcgaaatccctgccgttcttcgtcacgcagagagaaacgcctacgggcatgcggacccggcgggcaggtagccatggccgcggcggccggtgactccccgaactcctcgatatcgatcatgaggcgggctgctgccgtcgggttccgttccccggcggcggcggtctcagcgccggcgccgggggttttgccggacagcccggggtatccggctggggaggggccggggcgacgggtgtccgggtgagcggctcggatcgaggagaatttcgacgcatcgatagcctgcatccatgatgcgcgcttggatcctgccgatgctgcttgtgctcagcggctcagccgtcgcgactgggcagatcttcaaggggagccccggcacggcagcggcactcctgccggcgttcctggcgctcgccgctgtgaactcacccctgatcttcccgaggtcggttggtgcgcaggaggcacaacgccgcagcacggtcgacggccgaccggtcgtcttctggcggccgggctgcaagtactgcatacgactgcgcatccggctgggtcgcagcgccagccaattgcattgggtcgacatctggcgcgacccggcaggagccgcagcggtgagagcggccaacgacggcaacgagaccgtgccgaccgtcgtcgtggcgggccggccacacatcaaccccgatcccgcatgggtgcgcgaacagctctccccctccacgcggtcaggaaccgcgccttgaggagaggcacccgcagcaatacgtactgagtcgattgccgcccgatgtcacaggccgaaggcgccgccctcgatgaggatgagcaggccggtggcgatcaggaccaccgggagcaggatgtggccccagcgggcgagggccttggcgatgacgggtcgggtggcgaagaacttgcccgcgaagcaccacacggccaccagcgcgaggaacaccgcggcgtacacgctcatcccgccggctccggcggtggcgaagacgggcacgtagacgccgatgttgtcgccgccgttggcgaaggtgaccgcggcgacctccagcgggctcggcccgccctccttcgcctgttcctccgcctcgcccccggccccgtcgcggcggtccttccacgcctgccaggccgccttgaggcctaggttctgtctctttggtcagcgtcgggtccagatgaggatgccggcgaggtggagtgcggcctggtaggcgatggcgagcttgtcggttcgtgtggccaggccgcgccactgcttgagccggttgatgcagcgttcgaccgtgttccgttgcttgtagacctctcggtcaaagccaggcgggcggccgcctcggtggcctcgccgcaggcggtggccgatctggtcggacggctgcgggatgaccgcgcggatgccccggcgtcgcaggtggctgcggatggctcgggaggagtaggcccggtcggccagaacgacgaaggggcgggtccgcggcctgcccgtgcctgtgcggggcacccggatgcgggccgtcaccgtctcgaaggcgggtgcgtcaccggcctggcctgcggtgacggtgaatgccagcggccgtgccccaccgtccgcggccaggtgaaccttggtgctcagcccgccgcgtgagcgtccgagcgcgtgatcggagggctcgccggagcgggccgcccccttttgcgtgcgccggccgcgtgctggtgggcccggacgaccgtggagtccactgacacggtccagtcgatgtcgtcgtcggcgtccgccgctgccaggacggaggcgaggattttctcccaggtgccgtcgacggcccatctgagcagtcgtttgtgagcggtctggaacgacccgagctcgtcgggcaggtcccgccagggcgagctcgtgcggtacttccaagcgatggcctcaagggtgcggcggtggtcggcccaccgccggccgcggaccggatcggccggcatcagcggctcgatccggccccacatcgcatcagtgatcactaatcggacagacacatccgatcaactgaccaacccatcaaagagacacgctctagggcgagcggcagcagaccgagataggggatgccggactcgggcaggaaggtggcgccgaacgccgcggccaccgccacggcgaggatcgcggcgaagcccaggtactggcccagcacgatccggcgggtggacccggggtggccggcgccctgggcgaagaacagcgccaggatcaggatgtcgtcgatgttcgtgacggcgaacagcccagctgcctgcccgatgatgcccagatccacgagtagctgctctcctacgatgcgagtatcccggtgacgctaccgggagcccgtaccggtgggatcgcgggcctagggcccgctgccgtcccctctcgtgaacatcgaacacgggcagactgcagcgcagccctgccagatggggctttccaccgccgcgaaggccgtcgtcgggcgcgcaagcacgctgcttggacaccgtccccctacccgtcgacgtcctggcaccgctggtcgccgaatcggggttggtcacaaacagccgccgggagccacgggcccacgcccgcgacccccggccgcgtgttgcgcgaccggaactacttcttgttcgtcgtcttgtccgccaggtcctcctggaagggcttttcgcacgcgggcccggtgtcgacgaagacaaagctgtcctcatcagtcccatccgcccagccctcggggcggtggctcgcgatgagacgccagccgctcttgtccagcaccttgacgaccgactgccgctcctcgttgctcccgccctccttccagcccccgttgcccagcgcggcgagcgtggcgtcgtaggacttcctcgagtcggcggctttcgcaccgtccgactgccacctgaccgtgcaggacttgaggaccggcgggacatcgtcccggggcttctcggtgaacccggccgccgtggcggcggccactatctccttcttcaccaccgcgatgtccaggctgcctccggatcccgccttcgccgaggccgagcctccggttgacggtgcgtcaccgctgtgcccctgagccgaatctccttcactgctgcaccccgcgatcaacagcaccgcaccggcggccgcggccgcccacctgatgttgcgcacgacgatgccccccttcacgtccgcggaccagtgcccgcgatcaaggcagcagtctgccaccgccgcacgccgacacgaactgcttccgcctaccgccgggatggcagcgcggcgaggcccgtcagggctgggggtggaggctcctgtgtggctgggggctcggccagggccacgcggtcctcggccttgagacgtacccctgggctgccacacagtcccggcccaggggcgatccctcggactcgcaatcccggaattcccagcgcccctactcggtgtcggcccgctttataggccagcaggcgagggtgctgctgcgaggaaacgagcttctggtcttcgaacggcgcaagatcgtcgcccgtcacccgcggctgaccagagcgaagacgaccgcaacgatctcgatcactacctggagagcatgccggtcgagtccggggccctggccggatcgaccgcactggccgccgctcgcacggaaggcacccaccccccgtccacgagacggtctgcgcggcagcccgcgccgcccgcgacctggccgcggtaacgggtaggacgagactcggcggttactggaggacctttccctccggaggaatccggtcgcgctctggctgcggaggcgacaggatgcggccatggctgacgatctcttgctcgttcgcgcccgggagctgtgggtggagttggcggacacgccagtcgagttctgtccctcaggaggggcgatggtcgtggtcgcgcccaggtcgcggttgtctccgccgtcgtggacggggatcgtacggatcggtgacgcggccatcgtcactgcgccgagcgtgtggtctgccgggatggtggtcgacgccgcgcggaagttgacccacgaagagctcgttgacgtcgctcgtctgcgtgcggtgctgcctgttctcgatgcgcttgggccggcttcgctcttctatctcggccgggacggctttcttcctgcgcatgaaggcaccggcgtagaggagttgccgatcggcgatggcggcgtggccgcgctactggccctggctcgggaggaggaggtcggcgagagcggcctggaggacatctcctctcccgcgttctgtcttcggcggggcgacgaggtggtagccgcggctgggtaccggtcctggccgcggtcggtagcccacctgagcgtgttggttgccccgcactgtcggggccgacgtctggcccgggccgtggcgtccgcagcagtggcccatgccctcgatgccaggttgctgccgcagtggagagcacggctccatccctcacggcgtgtggctgtagctctggggttccgggaactgggtgcgcagctcagcattcggcttgggggcgttcccgtcgaccagggccggtaaagccagagcctcttcgaaagtcgtgtcgtttggcaggtcagcatcttccgcggtctggatctggtaggggacggcacgcgcgcggggactggcccctgagggagctggacacgtcggcccccacccagaccttcagctgtgactacacggcgcatcactggggcgagagctggtcccgtcggtggttcatcacccgtgccgactggaatccttccgacggcttgagtcggccggatctggagccgaatccgttcctggtcgaggtgcacggttcgccccaggaacagggatccatacgagccggccgtcgaccgaccggggcagccagcgacctcaccgccttcgtgctgaatgtgtgtgttcctggggcggagcacctgttcaggcgaaggccgtttccccgtacggcgataccgaaccgtgcgatcaagtgcgacgcagcgttcgaggaacggtttctaccggcggcgcagagatccgggcccgcaacgagtggaccagtcaccggccggcgacagacgcactccactggcctgcacgacgacgaagccgccgtcttcgaaagcgactcgatcaccggcggccaggaagagcgggctcgccaactcgaaggcgtacccgtcgtcagtctcaaggtcctgcaccagcaccaaccgcgaggtcggcgtggctccgtcagctaccaggcgcatccccagaggatcccacgcagcctgagatcacctcgacctcattcagtggctgacccacggcccagacgttgaggaccaagccaaggggtggcccgtggctgcgggagcgtgaggacccgcctcggatcagcggacatcagaggaagagaagttcgacgtccgtcgtgacacacagccgcagaacgaccgtcagctgttcggcagcatcgatgtgtgtccgagagacgccgacctcattccgccactggccggcgatcaccccgagccgggggaggagcgcagcgcattcggtgggcgagagctcgcctccaccgtcatcggggcgatcgaggagtggttcgtgggaggtggagacatctctgacggtcgtcctcgcctcagggatcgccggaagcgcgcccgccacccgatcgcgggcgcaggcccgttggtggtgaggggtgaggatcgcagcggtcgaggaggcgtccgtagtcggtccggccgcgcggcgggccctgccgtgacgccggagaagccaccgcaactcgtctcagccccggaagtgttacggcgttcggcgcggcacgaacgaacgactccggcgacgttctggtccgggctgtgcgccccgactccagtccccggagaggtggcgagcgcccactccaccgccgcctaggcacggtctgcgccgaccttcaccggcaggccgcggggtgccggtcagtcggagcccgaggtcgcggcaggcttcgccaccgacagcggctcggcgatgtcctccagcgaacgccgctccgccttgaccgccaggaacgccgccaccagacccgcggcgcacatcagcgccgcgccgatccggaaagccagcgcagtgtcgcccaccacgcccgactcggtcagctcggcgaagatcagcgggccgctgataccgcccgccgcggtgcccagggcgtagaagaacgcgatagccatcgcccgggtctccatggggaacacctccgagacggtcaggtacgcgctggaggcacccgccgacgcgaagaacagcaccacgcaccagcagacggtcatcgtcgtggccgtcagcgagccccggtcgaacagccacgccgtcacgaacaggagcgcacccgagagcagatacgtcgaggagatcatgatccggcgtccgaccgtgtcgaacagcttcccgagcagcagggggccgaggaagttgcccgcggcgatgaccgcgaagtagtaacccgtgtggcccgtcggcacgtcgaagaacgtcgtgaggatcgtgccgaacccgaaggtgatggcgttgtacaggaacgcctgcccgatgaacagcgacaacccgaggaacgcacggcgcgggtagcggccgaagaccgtcttggcgatcaggccgaagccgatgctcttgcgctgctggatggtgatctcgccggccggcggcggcagccgctcgcccttctcctcctcgatccgccgctccacggacgacaccagctcctcggcgccctgctcctggccgtggatgaactgccagcgtggactctccggaacgtgccggcgcacgagcaggatgaccagcccgaggacgacccccagggcgaagctcagccgccagccgaggttctgcggaaagatggcggtgtccagcatcaccacggacagcagggcgccgccgatcgcgccgagccagtagctgccgttgatgatgaggtcgacccgcccccggtagagggaggggatcagttcgtcgatcgccgagttgatggcggcgtactcgccgccgataccgaagccggtgaggaaccggaagaggaagaaccaccaggactcgaacgacagcgcggtcatggcggtcgcgcccagatagacgacgagcgtcaccatgaacagcttcttacggccgtagcggtcggtcagccagccgaagaacagtgcccccgagcaggctcccgccacgtagagggcggcggcgatcccggtgacctgggcggcggtgatgtcgaggccactgccctcctccgcgagacgtccggcgacgttgccgacgatggtgacttcgagcccgtcgaggatccagacggtgccgaggccgatcacgatcatccagtgccaccgggaccacggcagacggtcgagacgggccggtacggatgtggtgaccgtgcgcatggtggccggcgcggagccctccggcggcgaggcggatgccatggttccctgttccctcctactcgattcccccgcacagccgggttcccgggaacggtccggacatgcttgcggcctcgcggcccggcgtcggacggccccagcttgcgcgcagcccccgtacccaccggccgcgacacacggaaacggcaggtcggccggtgctcgcggagtggtcggaggcctgcccggctgtatgaacggcacgaaccgctgatcgcccggcgtgacggacccaacagcccctgtggaaaggcccggatccggagcccgtaggcgaggcccgaaccgcaccgtggccgatcggacgcccgccgtgccgggtgggtgcgttcagacggccgtcggctgggcacacggtgtctgcacgacctacgccaccccgttcggttcaggagacgccatgaccctcacgcaagagcccgccgagtcgagcgtgcagccccctcggacgctgcccgcgccgaccgccgaggcccgggtggcccggctccggcggcgcctggagcgcctgatcgggatcgcggcgaccgagggcaacgccctcacccccttgcgcaacggggacgagatattcgccgcgatgctcgccggcatccgcagagcccggcacaccgtggacatgatgacgttcgtgtactggaagggcgacatcgcccgtgacttcgcgcgggccctcgccgagcgggcccgcgccggagtacgggtccggctgctgctcgacggcttcggcagccgcctgatcgagcgggaactgctggatgccatggaggaggccggcgtggaggtggcctggttccgcaagcccctttacctctccccgctcaagcagaaccaccgctgccaccgcaaggtgctcgtcgtcgacgaggagatcgcgttcaccggcggtgtcggcatcgccgaggagtggtgcggcaacgcacgcaacgcacacgaatggcgcgacacccacgtcgaggtccgggggcccgccgtcgacgggatcgccgccgcgttcgcgcagaactgggccgagtgccacgacaaactgttcgacgagcgcgatcggttcgtcgaccaccgcccgcagggcgacgcgatcgtgcaggtggtacgcggttcggccagcttcggctggcaggacatgcagacgctggtacgggtcatgctggagtccgccgaggagcgcttccgcctggcgaccgcctacttctcgccggacgagtacttcgtcgagctgctgtgcgagacggcccggcgcggggtcgaggtggagatcctgctcccgggcccccacaccgacaagcgggtctgccggctcgccggtcagcaccactacgaggccctcgtcgcctgcggggtgaagatctaccagtaccagccgacgatgatgcacgccaaggtcatcaccgtcgaccgtgtcgccgccctggtcggatcgaccaacttcaaccgccgctccctcgaccacgacgaagaggtgatgctcgccgttctcgacgaggggttcaccggtgtcctcgacggacacttcgacgaggacatcgcggcgagcgaactgatccaggagggtcgctggcgcaggcgccccgccctccagcgggcccgggagctggcggtgcagccgatacgccgcttcctgtgacggtcccgcaccggccgcggccgccgtcagcggccgccctcagcgggagccgggcagggcggaggcgacggccctggcgcgatcggctgtacgcgccaaggccgccttcacggggcggcgtacggcatgcaccgggtgccgctggtccagtgcgtgccgtacgcggtgggcgagggagggcttgccgtgggtgtccgcggctgcgatgaggagccctcccacagcggacaggtcggccaggaaccgggcgcgctgccgcgcacgttcctccgggtcctccaccgtccagaaggcgtgcgcggcgagggacgtcggcaccagcgtggcagccagtgtgagcgcggccacgcgcggcacccgccccgtcgcgagcagcagcgccgccgcggcctggacggcgccggtgatgcgtaccacgtggagcggatccccggcgagggacgggacgcgctccccgacggcccggaccaggggctgggcggcctccgcgacggcctcggggcggcgcagggtctggagcccgccggagacgaacggggcggcgagcaggggacgggcgagctttcgcagggcagccatgtcccgctgttgccccgcggcggcccgtccatccgtccagccgtccctccggccttcgtcaggactcgccgtcgacccctgtgaccgccggagctccgagaggcgcgtccttctccggcagccccagctccgcgagcgtgccggccagcaggcgcacggcgtcctcctcggccgtggcccggtccggggcctcgacctccagacggacggagaaggtgccgccctcgtagacggtgagcagttccacgtcctcggtctcgctcagtgcggtgtggtgcgaggccagcctcctggcgagctcggagcgtgccgcatcgtcgacgtccctcaggaacgtaccgggcacggtgatgacgtaggtggtcacttgctgcctcctgtcggctggcaatcgctgagttgtgtgcatgccccggcgtcgtgttgcaaacccccacaagcccggcagaacaggctatcggaggcgggtcgtggcgatccggcggccgagcatgcgactcgcctacccccgcctacgggtgttgaacagcggaccggatccggcccgagtgaggaacatccggcgaacgatggcccccgtcactgcatagagccaccggtaccggccaggagcgtgggtgagcacaaggacgaatggatggaggaacgacgatgaactggcgccacgaggccgcctgcaggtgggaagaccccgatctcttcttcccggtgggcaccggcggcccggccctcctccagatcgaggaagccaaagcggtgtgccaccggtgcccggtgagggagaactgcctgcagtgggccctcgatggaggtcaggatctcggtgtgtgcggcggtatgagcgaggacgaacgccggaccgtcaagcggcgggcggcccgggcccgcgcccggtcggcggactgatccgcgcccggaaggtaacggaacggcgtgggccctgcggccgttagcgtctgcggccccacccgcgggccgggcgcgtgccgcctatgcccgcaacgtgcagcgcgagcgcggcgagaccgatcagcatgaggttggtcgagctcaggacgtcgttggtggcgatgtcggcggcgtcgatgaggaacgcgatgaagaacaggactgcggcggcgatggccagcatggccgggctcctttcggtcggtgccgtccgtgtaccccctccgggcccggccatgagcgcggggagcacggccatccggcggatccgtcccgtgagcccctcccggcaccaccggcccgcaagccctgccggcccgcacgtgtgacggcgggccgacggggaaggcgaggggcgtaccaagatccaccgtgacgaggagaccgaccatgaacggacagcagcaggcggccccgcacaccgtccccggtgtggaccgccaggacgcacgacaggtcacggagatcctgcaggcgcgactgcacgcgctgaacgatctggccctgaccctcaagcacgtgcactggaacgtcgtcggcccgcacttcatcgccgtccacgagatgctcgatccgcaggtggaggcggtccgcgagatgacggacaccaccgccgaacgcatcgcgacgctcggcggcgtgccggtcggcacaccggccgccatcgtcgccgcccggacctgggacgactacgacgtgggccgcgcggacgccgtcgcccacctgggcgccctggacctggtctacagcggcgtgatcgaggaccaccggcgagcgatgaaggcgaccggcgaactcgacccggtcacccaggacatgctcatcggccagctggccgggctggaacagttccagtggttcctgcgcgcacacctggaatccggcggaggccgcctgagcacggcgggcgcccacacccttcaggaggcggccgaccgggcgtcgcgaggaaccggccccgcctgaaccacgcacagcccgacacgtcgacggccggtcacctcccgcaggtgaccggccgcttccgtgccccggaccccggggcacccaccacagggacgacggctccccgtctgacggtcacgcaaaacaccaggcgggagcgggtttcccgaacgtttcccgtttcccgtcgcgatgggcgacccgtgcctcctcgacacaccgcggtggcacgggacaggctcggagtgcccggcggaacggccgggccgtgccccgtacgacgggcacaccgcgcgaacgacacgacgagtacgacgacccgcgggcgaccgcgacggggacgggggaccggacatggggatgcggagaacagcgatggcggcggtcgcggtgctgagcctcctggccacatgggaaggcaccggcggcgccaccgccaccgccgcccctgcggccacggcatcgcaggcggcaggagcgtgcggcgtccaggcccccggagcctccgccgcggccgaagccgccgtacgggccgcgtgcgaacagatcggcgtctggtacacctggggcggcggccacgggccgcagccggggccgacgtacgggctggtcgacccgagcgacccggacagcgcccacgacccggaacggctgggcttcgactgctccggactggtccggtacgcctacgcccgcgcgctcggcggcgaccctctgcccggcaacgcccaccaccagttccattccccgcacacgaacgagcgcttcacggcggcccaggggaccggtccactgctccccggggacctgctggcgtggggatcggcgggctccgtccaccacatcgcgatctacctcggcgcgggcaagatggtcgaggcccgggagtcgggcacccggatcaccgtcagcgacgtacggctgggcggggactacgcgggagccgcccgcatcgcgccggcgacgacgcccggcacgttcagcacctggggcgccgacgtgtggacccacgaagaaccgtccaccggcagcccgcgggtacaccgcttccccggcccgaccagcgtgcgcgtcgaatgccagaagcacgccgagacggtgacggcggacggctacaccaacgacgcctggtcctacctgcccgagtacggatcgtggatcaccaacatctacatcaagggcgccgcctggctggacggcgtacccacctgcccctgagcaccgtccgcaccaccgatcacgcacaccccgcacatccaccacacggctcctgagggagcccttccgaggaggaatcatgtacgcaggcaggaagatcgccctggggatcgccaccgtcgcactggcggccggcgcggccaccgtgaccgggcccgcccaggccacgccggccaccgggaagagcgcggccgccgagtgcggcgtgcgcgccgacggcaagctgtggtgcggcaaccgggtcggtgccaagggctatgagcaccgccgctacaactccgcggtgcgcggcccgctgaacacgagccccagctggttccagtgctggggccgcggcgaccagcacgccggcggcaacaacgtctggtactggacccagctggacaacggccagtggggcaacgtcgcggccgtggacgtccacacctccgtcgaccccgcgccgggcctgcgcgagtgctgacaccctgatgtccggagcccctgggaccgttcggtacggcaccgcaaacgcgggcgggggtacggcacgcggaaggggccgacggctgcagccgtcggcccctcgttcaccggcagggatcagcaggtcccggcgggccgttcccggaccaccaggtcggtggagccggtggtcgcgtccagccaggtgacctgacggcccgccccggccgccgggtagctctgctcaccccggttgcaggagacccgctcgcggcgggagccgtcggtggtcagctgccacagcttgggcagcgactcgttgcggtagcgcgtgtcgggcgtctgcgcgaccagggtcagcgcgtcctgcgagaccgtcaggtcggaggcgatgaaggcacccggcttgtgctcgctgctgacgatgaaggtgccgcggccgtccaggccggagctgatgaccgacatcagaccgccgtcgctctcgtcggtgtccgccagccagaacacgttcttgccgttgatcccggtctggcccaggcccgtcggctcgtcgagctgctcggtcatgaccgccttgccggtggagaggtcgacgacctccacgcccagccggtaggtaccgttctgcgggtacagcttcgcgtaggcgatcctgccctcactgatggacggcagggcggtcagggtgttccacttccgcccgtcggtgaagaccggggccttgtcggtcggccgcatgtaaccgacgtgccggccgccgaggatgtcgtactcctcgaacacgaccgtgttcttctccacccgcagacccgcgacgcccgtcatcgagctgtacagggtcttgatcggaccgcccgccacgggacgggagaggacgtcgaccgaggtcgggccgtacgccgtccacaccacggtcttgccgtcggtcgccggggcggtgtggtagcggccgtcgttggggctgaccaccttcggggcgcccttgccgtccagccggcccgcgtacaccgagtagggctcggagccgtcgtcgttcgacttcgacgccgtccaccagccgccgcccgcacccacgccggaatcggtggtgttcagcttgccgaacagggtgtcggtgtcgatgccgagggcctgctcccagtccgggacgatgccgtgggcgttgaacgaccgcttgaccgtgttctgctgggcggaggtcgcgcccagcgccttggccgccgcgagcaccgcgccccgggcctcggtgaacccgtcgagcggcgtcatgtactcactgacggccttgtacacgatcttgtcggccagggcaccgcccaggtcctcgcgcatgtcccacagcgcgccggagaagatcgtcgagttcaggtgcacgccgccgttgtcggtggcgaacgacacgcccaggaagctcttcgaggtggtggccccgtcgttgaggtcgcgcagggcacagtcggcggcggccttcgtgcggcacaggttctcaccgatgaggcccgcggccggatcgctcatcggcgtcccgctcgcggtgacgtcgatggcgttgccgaagtagtccgccagcgcttcgttcagggccccggactggcccgcgtagaccaggttcgccgtgtgctcgatgaccccgtgggtcatctcgtggccgacgacgtcggtgtcggccgacatcggcttgtactcgtcgtcaccgatgccgtagaccatcttggtgccgtcccagaacgcgttggcgtagggcaggccgtagtacgtcacaccgaccagggagttgacggccccgccgttcccgtcgaggctctcgcgtccgaggttcttcttgtagaagtcgtagacctggcccgcgttccagtgggcgtccacggcccccgaatccgtcgccgcggcgccgaaagaggtgttcggggaggagaacatgctgatgccggcgggccacgtgcccgaggtctccgacaccgacttgccccgggcgtcccacgtggccagcagactcttgctggtggcgcgcatccggcccgcgtcggcgaggaggtactggccggccgccgggtcgtaggcgatgtccagcgaggccgcggcgccgctcagccgggcgccggaccccgtctcggggaccaggttcgcgggaacggcgggcgggccggccgcgcccggaccctcaccggcctcaccggccgtccgggcggccgcgggagccgccatcgtcttcaacgcgctgtactggagcgccggatagcccgagcgggcgtccacgtacacctcgtccacgaccggcgccccggtgcccggcgcggtgccccgtacggtcacccggtaggcgaggacaccgccgcccttgggcaggaccacgagccccttggcgtcaccggtcatgccggtggccgccggatcaccggactccgagcgcggcgcctggctcttgttcagggccgctcccagccggcgggccgtggcggccaccgcacgccggactgcgacctcctcgctgacctggggggtgacatcggtgctcagggcggtgaagtagtgccccgaggtaccggtgaccacgcgcttgccgtcctgcttctgcatccgcacgacgtactggccgcccaggacgtcgactccgcggtgcttctgctgcagccggaccgtctcgtccttggccccggtggccgtcgccgccaggggaacgaggtcgctgcccgcccgggggatcttgtagcggctcttgttcgcggcgaggtgctggcgcgccgcgtcggccggggcggccttggcgtccacgggctcccggatgccctcgacgagcaccggggtcgctgtgtcctggccgggaacggcgttcgaggggccgcccgcggcccacgccggcgacgcctgcaaggtcattgcggcggccagcagaaccgctaatcctccggcggagcggatctctttccgccatatccgtcgtgcggcgggagtggacgccgacgaacctgcgctgaacttgggcaaggggtctcctcaaccatgagtgcctgatgtgttgctgcgagttgccgccatgcaagcgtcgcgagcggctcccgaccagagccgaggccccctcagaagtggccatgcacacttgtgggggctctgtgaaggcggtcaaaatcccccgcatgatcgaaaccgacccgcacgaccggactccggcccgcacgcaggacgaccgcagggcggtgatccagacggccgccgacccggcctccgtactgcacgtactcatccagcgccgccaggccctcctgcaccaggagtcggccgacctgaactctctgcgctcctacgccgaccggctggcccaccggcttcccccggagcccgcgagatcccccggccccccggccggaatcgaggttctcaccggcaccgatgcggtcggcacccgcctgcgcggcatgctcgccgcagccgagacggaggtgctgatcctcgaccgcgcgacgcggacgcccggagcgcccgacggggacctcgttcgcgatctgctggcgcgcggcgttgccgtacggaccgtcaccgaccggcgcggtaccgacttccccgaccgcgcgcacgagctgatcgccctcaccggactcggcctccaggcccggatcggacagagcctgcccaccgccctcgtcctcgtcgaccggcgcacctgcctgctgcccccgccgcccggcaacgacgaaggggacgacgaagcggccctggtgctcggcgactgcctgctgcaccgggccgcgctgccgctcttcgaatccctgtgggcgcgcgccacccccctcggcagcccggacggccccctcaccgccgaccaacgggaactgctcgggctgctcgcctccggcctgaaggacgaaaccatcgcccgccggctcggcgtacacgtgcacaccgcccgccggcggatcacccgcatgctggaggaactcgacgcggacacgcgcttccaggcgggcgtccaggccgccatccgcggctggctccccccgcaccccgagacgcccggcggccccgggccgacggcgatggcgaatggctgagccgcacgggggacgggggagaaccctcggcttcgggcaggcgcagtacgtcctgctgcctctgcgccgggtgtcggctcgggccgccttccgccgggcggcggccgtaccggccgggcgccgcgacggctccggccgggcgggtgccagagccctcggaaggagcccggcccggcgtcacgccgcccgcgaggccggcaccggacccggggtccggcgggagggagagcgggggaggcgccgggccgggcgtcagagcgcagtgggcgcccgcctctcgcggctcactgcccgtgcagaccccactcgtcgagccccgagtacacgagtgcgacgcggggcacgccgcgggagaagcattccgcctcgccgttgtgcagggcgaccagggagtccgggccccgccaccacgtgtcgaccatgccctgtacttcctccaccggctcgaaaccgtccaacgggaaggacttggcctcgtcaccgtgcagccgtgtgacctgctcggcccagtaggaagcgtggtgggtgagcgccagggactccacccagccctcgatggacgcgtgcagcggagcccacctgtcgccccagagaccgaactcgccgttcgggccgatcatgaaggagaaggcgaccgaggcgcgttggtcgccggccgggaaccaccacccgccctcgtcggaaggctcgggcatgtccgcgcacaggtagcggggaccgctctcgtacaccggcgccggagggagcaccatgccgccccagcggtcctggtagaccacggcccggctgatcacatccccgggcacaccctgtgcgagccactgctcccgatagggctccagggacgcgacatcagccctgaccccgtggtgcgcgatgaaggaacgggcgcgccgggagagcccgtcgggaatcgcggtgccgtgcaggttcaggttcatgaacatgacgctatcgccgccgggccgcgtcacggcgccgggggtcctgcggcgccgtcgtccgttcatgtacgggcgacgccggccatccaggggatccactgcccagcgctcatggccccgtggcgtacgggcgccctgaccaaggctcccgtacgccactcggcccgcggaccggggtcgaccggccgcgatggccgccggttaccggctaccggttaccggctgagcgatgtgagcgccgcggcgtcgtacggcttcagctcgtcgaaacggttgccgaggaccttcgccgcccactgggggtcctggagcagggcccggccgacggcgaccatgtcgaactcgtcacgttccatgcggtccaggaggttgtcgatgtcaccgagcgccgaaccctcgccgatgaaggcgccgatgaagtcgccgtcgaggccgacggagccgacggtgatggcgggccggccggtgagcttcttggtccagcccgccaggttcaggtccgagccctcgaactccgggagccagtagcgccgggtggaggcgtggaacgcgtcgacgcccgcggccgccagcggggccaggatcgcctccagctcctcgggggtctgcgcgagccgggcgtcgtaggcctcctgcttccactgcgagtagcggaagatcaccgggaactcggccgagacgcgttcgcggaccgccgccacgatctccgcggcgaacttcgtccgggccaccgcgtcgccgccgtacgcgtcggtacggcggttggtccgctcccacaggaactggtcgaggaggtagccgtgggcaccgtgcagttcgatcccgtcgaagccgatccgctcggcgtccgcggcggcgtcggcgaacgcgccgatgacgtcgtcgaggtcggcgcgggtcatcgccttgccggtcccctcggtgccgtcgacgcggatgccggaggggccgacggcgggcgcgtcggcgtacggggcctggccctgcttgcgcaccatgcctatgtgccacagctggggcacgatggtgccgcccgcctcgtggacggctgcggcgaccttcgcccacccggccagctggtcctcgccgtggaaccgcggtacgcggtcgctctgcccggcggagtcgtgacccacgtaggtgccctcggtgacgatcaggcccacaccggcggcggcccggctggcgtaatacgcctgcacgtcctcgccgggcacgccgccgggggagaacatccgcgtcatcggagccatcgcgatgcggttggggacggtcaggccgttcagcgtgacgggccgggacaggatctcggccgcgcgggaggcggtggacgtggtggcgctcatgcgagtcctccgggttgaggctgtggctcgtctgggtgacaacgagaagtgcatagtacacacgctatgtatcatgcatattgccgccggatcccgcgccgacctcctgcggaggccctgccaggccctgctgagcctcgtcagggtctgtcggcccacgagtccgcgataatggggcgtcgaaaaggtgaggaggggcagtgctggagaatgtggagcgggaactgatgctgctctcgcggcaccaggtgctggcccggcgcgagcgcgatcccgagcgcctggagcggtcggcgtacctgctgctcagccggatcgacacccaaggccccatgtccatcgggcagctggcggaggccttcggcctcgacacgtcgaccgtgaaccgccagacggccgcgctgctgcgctgcggactggccgagcgcgtcgcggacccggacggcggcatggcccgcaagctgcgcatcaccgccgaaggcgcgcgccggctcgccggagaccgcgaggtcaaccagtcctgcctggcccgggtggttgccgactggtcccccgaggaggtacgggagctggaggacgtcctggtccggctcaaccgcagtgccgaggcactcgaaggacggcactggccgcgcacggaggacgacgccgcccgcgccgcatgtcacccgcaggccgcgcaggaatccgcggcgcccgcgtcgccggactccacgaaccctgccccgcgggcacccgccctgtaattccggaaacgcgcggcctcggcccgaaggggcgcccgctgcccccggtgacgccgggggccggtgtacgggccgccgctcggcctggcgctaccggtgccggcgccggtggctgtggctgtcgcggtccgggccgtggacgtgtggtcacccgccggactccgcggtgcccgcgacggccgccgcggcgaaggcggcggcgctggtcgcaccgcgctccggggtgccctcgaagcggatgcggccgctgttgaaggcgtcccacatctccacccagttgtcgatggcggcatcgggcagccccatcccggcgaggacggcccgccactgctcgcgagggacggtctgagcgatgacgtcccggcccagggcctgagcgaaggcggcggcgatgtcgtccggcgcgtagtcggccgcggcggccagctcgacggtgcggctgtcgtcgcggagcagctcacgtacgacggtcaccgcgatgtccgccacggccgagtgcgggacggggtggtcgagcggggtgaagaagctgggcagcaccccctcgcgcatggccggcaggctgggcagccagttggtcaggaagttgccggcccggacgaagctcgcgccgagcgggcgcaacgcctgttcgaggaggtgggtggtggcgatgttgccggtgccgtcggcgtgctgcgcgccgatcgaggacagggccacgagtcgggtgccggcggccttggcggcttgcgcgtagttggcggcgacgtcgcgggcggaagcgtgcatgtccccgctggcgtagtccggcgggttgagcacgtaggcggcccgggcgccggtgaaggcggtggtgagagcggccgcgtcgtgcacgtcggcgtgggcgacctcggcgccgcgctccttccagtcccggccctcgcgacccggcctcagcaccacccggacgggccggtcctggtcgagcaggccgagggcgacggcccggccggtctttccgccagctcccatgacgacgtacatggtgcatctcctccggtgagtgggggtggcccggtggtgctccggacggagcggggctgcgattccaccgtgcgacggcggcaggcccgctgtccaagacctgttgtgcactgcgcgataccgaatggacatcaccgcaggtcggcggcctttcatgagagatgtgccggaccgcgggcgggctaccgtggaggcatgcccgacactcccaccgcctccgacggcgctgccgatctggacctgcggctggtgcgctacttcacggtggtggccgagctgcgccacttcgggcgcgccgccgcggccctgcacctcgcgcagccgtccctcagccggcagatccgccgcctggaggaccggctcggcgcccggctgctggaccgtacgccgcacggcaccgagctgaccgacgccggccgcgcgctgctgccgcgcgccagggccctcctgcgcgccgccgggcaggcggtcgccgagacccgggccgccgcagagcccacccggctcaccgtcggctacaccaccggcctgatcatcaccccggcggtgcgcgagctgcgccgccgccaccccgacgccgacgtgcacaccctgcacctggcctgggaccggccgcgggccgccctgctggaccaccgcgtcgacgcggtggtcgcccggctgccgttccccaccgaccggctggaagtgtcggtcctgtacgacgagccgcgcgtgctgctcgtgcccgccggccaccgtctggcgggcagggagcgcgtcaccctggaggacatcggggacgagccgcagccccggctgcccgacccggcgtggaacgcgttctggcgcgtggacccccggcccgacggcagccgggcccccgtggggccgctcgtggacaccgtcgaggacaagctcgagctgatcgcggccggggacgcggtgtccatcgcgcccgccggctcggtggccgtgcacctgcgctccgacctggccgccgtgcccctggagggcgtcgagcccggacacgtcgtcctcgccacccgcgcgggcgaccgcggccgcctcgtcaccgccttccgccaggccgcccggagccgcctcaccgggcccccgcacccgggcggccccgctgtcgacctctgacgggggccgcgagtccgggggcaggggtgccggcgccggatgagggggtgtgggacgggcggggccggggaaggcgatagaccatacctcccgtaatcagacattggggacatggctgtggccgcacgtgaacgcaatccccggcgacaggccgacccggctccgaccaccgccgcactccaccgctcccgcgtcgcgctccgggtcaacggccggacccacgtcctcgacctggacaaccgcgtcactctcctcgacgccctgcgggagcggctggacctgaccggttcgaagaagggctgcgaccacgggcagtgcggagcctgcaccgtcctcgtcgacgggcggcgcgccaacagctgcctgctgctggccgtgacccaggacggatccgagatcaccaccgtcgaggggctgggcgccgccgacggctccttgtcccccctccagcaggccttcctcgaccacgacgccctccagtgcggctactgcacgcccggccagctctgctccgccgtcggggtcctgcgggaggccgccgccggacacccctcgcacgtgaccgacgcggcgaccgcggccgacagcacccgcccggtcgtcctgaccgccgaggaaatcagggaacggctcagcggcaacctctgccgctgcggcgcctacaacgggatcgccgacgccgtggcggcctgcagcgccgccgaggacccccgcccagccgcccggccgcccgccccagccctccggcccgacccgacccgaccccggacgtgaccgcgtgaagcccttcgcctacgtacgcgccaccagcctccaggaagcggcggccgcctacgcgagccaccccggatcccgctacctcggcggcggaaccaatctggtcgacctcatgaagcacggcgtggaaaccccgggcaccctcatcgacctcacgcgggtgccgctcgacgacatccaggagctgcccaccggagctctcaggatcggagccggcgtacgcaacaccgatctggccgcgcaccccctggtacgcacccgctaccccgtcctgtcacaggccctcctcgccggggcgtccggacagctccgcaacgtcgccaccaccggcggaaacctgctccagcgcacccgctgcccgtacttccaggacgtgtcgaagccctgcaacaagcgggaacccggcactggctgcgcggcccgcgaagcggtccaccgtgaccatgccgtcctcggccactccgcacactgcatcgccacccacccctcggacatggccgtggccctctccgccctggacgcccgcatcgagctctacggcggcgagcacggcaccacccgcgaggtggcggcggccgacttccaccggcttccgggcgagcaccccgaacgggacaccgtcatccgcccgggcgagatcgtcacctccgtggtcctgcccccggccgcgcccggatcccgctccctctaccgcaaggtccgcgaccgggcctcgtacgccttcgccctcgcctcggtggccgccgtactcgaactcggcgacggccgcgtacgccacgtcgccctcgtcttcggcggcctcgcccaccgcccctggcgcgccgccgccgccgaggaacggctcaccggcgccgtacccgccgacgaggccgtgcgggaggccgtcgacgccgaactggccgccgcccggcccctgcgcgacaacgccttcaaggtcgacctcgcccgcaacctcgcccgcgacgtcctcgccacgctgatccgctccgcctccgacgacggccctcccgcccgcccccggccgtgaccgcccccggccccgaaccgacaaggggacccgcgatgcccacccttcccgacagcccgtccgccctcggcagccccgcccgtcgccgtgagggacgcgagaaggtcaccggagccgcccgctacgccgccgagcacacgccccccgactgcgcctacgcctggcccgtgcccgccacgatcgcccgcggccgcgtcatctccgtcgacaccgcgcccgccacggccgtgcccggtgtgatcggcgtgctgaccccgtacgacgcgccccgcctcggcgcgacggacgaccccaccctgcacctcctccaggacccgcgcgtgccccaccgcggctggtacgtggccctggccgtcgccgacaccctggagggcgcacgggacgccgcctccgcggtgcgcgtcggctacgagagcgacccccacgacgtcaccctcagcgccgaccaccagcgcgtctacacccccgaggaggccaacgggggccaccccgcacaccgcgagcagggagacgcggacgcggagctcgccgccgctccggttcgggtcgactgcgtctacgcggtggggcccctgcacaaccaccccatggaaccgcacgctgccgtcgccgactgggacggggaacgccgccacctgacggtgcatgactccagccagggttcgggcctcgtgcgcagcgtgctggccgcactgttcaagctgaccgaggaccaggtcaccgtcgtatccgagcatgtcggcggcgggttcggctcgaagggcaccccgcgtccccatgtggtcctggcggcgatggcgtcacggcactacggcagacccgtcaaactcgccctgccccgtgcccacctgcccgcgaccgtcggccaccgtgcgcccaccctccaccacatccggctcggtgcccgaaccgacggcaccctgaccgctttgacgcacgagatcacgacccacacctcgcgcatccgggagttcgtggaacaggcggcggtgcccgcccgcgtcatgtacgccgtgcccgcgctccgcaccacccaccgggtcgtcgccctcgacgtacccaccccgtcgtggatgcgtgctcccggcgaggcgccgggcatgtacgccctggaatcggcgatggacgaactcgccggcatcctcggcatcgacccgatcgagctgcgcgtgcgcaatgaaccccgcaccgagcccgacagcggcctccccttcagcagccgtcacctggtcgagtgcctgcgtgagggcgccgagcggttcggctgggcgcgctgccgcgagccgcgccgagagggcccgtacctcatcggcagcggagtggccgccgccacctatcccgtgctcgtcgcgccttccacggcccgggcgcacgcccgccccgacggcggctacctcgtcgagatcaacgccaccgacatcggaacgggcgcccgtaccgtcctggcccaggtggcggcggatgccctgcgggttccgctcgactcggtgtccgtcgccatcggacacaccggcctgcccgcggcctcgctcgccgggggctcctgcgggaccgcctcctgggggtgggccgtccacgacgcctgcactgccctgaccgcgcgcctggagcgccaccacgagccgcttccggccggggggctgtccgcgtccgccgacaccacgcagtccgccaagcagaagcccccttactcccggcacgccttcggcgcgcacttcgccgaggtacgggtcgacacggtcaccggggaggtccgcgtacggcgcatgctgggcgtcttcgccgccggccgcatcctgaacgcgctcaccgcgcggtcgcagttcaagggcgccatggtgatggggctcggcatggcgctgaccgaacacagcacgatggacgcggtgttcggcgatttcaccgagagcgacctcgccgcctaccacgtcccggcgcacgccgatgtccccgccatcgaggcccactggatcgatgaacacgacaagcacctcaaccccatgggcagcaaggggatcggcgagatcggcatcgtcggaacggcggccgcgatcgggaacgcgttcagccacgcgacaggccaccgcctgcgcgaactccccctgacgccggaccgcgtactgtccgcactgggccgcgcacactgacacgaacgccggaggcgggagcaccgctgggcggtcagggtagcccgtgtgatcccgctgcgtggcctgtgctgggtaccgggctggctgcacggcaggcggacgccggggcagcgctgatcatgacgttctgcgcttcggttcgtggagccgctgaacgagaacgcagacggcttcctgccggcggtccgtccgtctgggtggtgtgggcaacgtatgcccttctcctggcctggggcccgctcctgggcgtcctcaccgtcgcgtacgcacgacgccgccgaacgaacgacgtacgggcgctgcggctcggcccgaagccggacggtcgttgcgatcggagaacggcattcggacccggctcgttgggtgggtgtggggctgatggtgcgggtctgagggtcgggaagtgcctgacggaggacggggcttgggtgcgtgggctttgttcgcgtcaagcgggttctggcacagatcttggggagtcgtcgcggagagttgccctgatgttcgagtgcgaggagtcgggttcgtgcgaaccgcgtacgccttgtcgtccgacgatcggagttgccgctccctcaggtgttcctcggccgccactacggtcgattgtggacggtgatggtgctggtcatgcagaccgatgcaccgttctgggactcactggtacgcgccggtatcgacgaggcggatgtcgaagcggttacggccgcgtccgggacggtcgaggtggcggcgagaggccgcgcgacctgctctgcatgtccggactgcggccgcttctcggatgcatcatgataagttgagaagttatgtctcacttaatgaagccccctcccattgttgtcaccggggccactgggacgatcggccacccggtcgtcgcagggctgcttgatgccggtcacgcggtgcgcggaatctcgcgacacccgcaacgtgcctcactcccggatggcgcggacgtggtattcggcgacctggacgacccgtccacactgaggcacgcattcgacggtgccgcgcaactcgtcctgatcgcggtccctgagaccgctgaggcggtcgtctctcacgccaaacaggcgggcgtcgagcacgtggttgtggtctcctccgccgccgtaacggccggctacgacacgacgtacaacgccgtggtcgagcaggccgtcatggactcaggactggattggagcatcgtgcgtcccggtgagttcgcgacaaactcactcctcatatggggaccagcgatcaaggtaagtcgccgagttgtggagccctttcctgatcagatcgggcatcccgtccatgaggccgacgttgccgatgtcgtcctggccaacctgctcgacccacaccgcctcggacggatcgacacgatcattggaccggaaagtctcaccaaacgcgaacaggttgcagtgatcgcagaagcgatcggagagcagatcgcgctcgatgaggtctccgccgaacaagcccgcgacttctaccgagcccaagggggtttcgcggccgcgaacgcagacttcctgttcgggttcgaaagctacgacggcaccgaaggcatcgcagatgaaccccatgacacgagggccccgggggacgatgcctacctcacgctcgaccggataacgggaactccagcgcgcaccttccgtcactgggcgcacggtcacgcctccgacttcatttgagcgatggcaggggtaagcactattggaggtcgcttcctcccgatgtttcttcccgtaactggcatttcatctggctgtaccgcgtcgcgccacgagatggtggcttcgccagtgaggcggcgggccatcagtcggtcagtagcggggtggatcacggcttcagagcgggcgggttcaggagcggtcagcaccccgggaccgttgccagtttgtggttctggcacagatcttggggagtcgttgcggggtgtcactggagcaggtggcgtgcgaagccgcagaggccggggagctggctggcgccgacgacgtcgatccaggtggggagggtggagccgaggcgatcggtgagtatctcgccgaagtcgcgaacgtgtccggcggcagtgtccagttccggtcagcgtgccaggactttcttcaggccggcccggtcttcgtcggtcagggtcgcggggtgccgggtgagccagccggtcacctgtcgcaccgtcggcggccgcggcggtgcggcggacggagccctgcgggatgtggcgatgtgcgtgcggactacgtcgtaggtggcgggagctcgttcggtaaccaggtctctgtgccgttgggtggtgctggtgcattcctcggtgaatcgccgttccgggtagggcttgtagaggtccagtgtgctgaaccgggcctggttctcacgaacggtgttctgtcagcgtgtggcgttcgtgaccggaggacggtgtgtcgaggcccgggctcagctgccgggcgatcgctcggcgtgagtgtccttgggcgagcgtctcgtggagcggggtgtgtacggttttcttgcgctcggcccgtcggccgacgggcgcctggtcgtgctgcggccggccggaagccagtcggttggcttgtggcagcatgcggctgggcgagggattgcgcaggcagtcgcggtgggcggcaacgcaggtgtccacggcgcggccgaggccctgccgcagatgggaccggtcggcgatctgcggagcgtcgggggcgccgtggcgtgtgccctcggtgtaggcgccggcccggtcccgggagatgatttccaggccggggtggaggatcagccaggcggccagcggcccggtttcacgcgtcgggagcacgtcgacgacgcgatggtcttcggcgctggtcaagacggtggagtagctctggtcgcgacggatcgcgaagtcgtccacgcccggcacccgcggcgtgctgaaccgcggatcgggcagcgccatgaccttgcgtaacaaggtcatccgtcctgggccgaagcccagttgggctgccgaccgagcgccggcccgcccggccagtgcgagctctactcgctccagggcgtggttgagccgagtggtgaaccgtgcgtgcggggcggccagccgggagaacggctcggcgaacgtccggcgagggcagtccgccgctccacaggtgaagcgccggaccgtcagccggatcacgaagccctgttcagtgagcggcaggtccttcagcctgcgctggtatcgatcgtgcactcggtccgagaagcggcctcagtgtctggtcttgttgtgtttgggtggtgacggtgggtgtgttgtggggggttggggggtgaggtgttgcatagggcgtgggtcacatacgaggggggttagtggtgtgtggggggtggtgtggtgggtgtggtgacgtgggtggttgtggtgggtggggggtggggtgggggtgggtggttgtggggggtggttagtaggtggggtcgttgccgggatggtggggcgtctgtagaactggacgggtcgccaggtggcacgggtgttccgccccgccgccgacgaacccctctccaccgtgtgagtggcttcacgcatgtcttcgacgtgtctgcgaccgcccttgttccctgtggaaggtttcctccgtgtccaacgctgtcatccgccgtatcgcttcttcccggaaggctcttgcgggcgctgttgtcgctgtgggtgttgccggttccatgcttgccacggttcctgctcaggcggctccggtgagcgcgaaggcgatcgcgcagcggatgatcaaggacccggcgcagttcgctgctttcgacaagatcatttcgcatgagagtggctgggattacaccgcgacgaacgcttcttccggtgcgtatggtctggcccaggcgctgccggcgtcgaagatggcgtccgcgggtgcggactggaagacgaacccggcgacccagatcaagtggggtctggactatatgaacgaccgctacggcagcccggtcggtgcgtggaacttctggtccgcgaaccactggtactgatccgttccgtccgcggacggcacgtgatacgcgagaacgcccggccggggtcttccggccgggcgttctcgcgtgttctgcccggcgtttgcgggccgtgtgtatgccgggatgcccggccggggttttccggccgggcatcttcgtgtgttcttccgggcgtttgcgggccgtgtgtgcgtgcgggggtgtccggctgggggttttcgggcggggtgttctcgggctgcgggccgtgtgtgtgccggggtgtccggcgggggttttccggccgggtgttttcgtgtgttctcgcgtttgtgggctgtgtgggccggggtgtgcggctggggttttccggtggggtgttcttgcgtgttctgccgggtgtcggcgggtggggtgttggcgggtgggcgggctggtgtggcggggtgggtggggttgtcggggcggggtgtttgtgtgtgggggcctgtcacccggggtgttgtgcctgttgtgcctgtggttcgtgttgtggcggggtgggtggggttgtgggggtgggctggtgtttttgtccggccgggttgaggggggtggtgtggggttttggtggtgtgggtggggtgtgggggtttgtcaagtcccgaatggtcgcggcgtgacggggtgtggggttggggggcttactcggggcagggacgcacgtgtggtgtgtggttgcggcgggtgtgtggacgggtccgcagttcctggtcgggcctccgggttgtggaggtgtgcagggtttggaaggagtgggcgcatgcgagtgactgtggttgacgcgttgtgttgtggtggggggcgggtgtcgtgagttctctgccccctccccctccccctccccctccttcttcttcttcttcttctggttcttctggttcttcttctggttctttggggcgtcctatggggccgccgcatggtccgttgtcgggtcggggtgttcgtgtggagccgccgcctgcgtcgggtggtgtgtctggttcgggtcctgtgtcgggtcctggttcgggttctgtgttggggccgccggcggggcctgtgccggtgtcttccggtgggggtgcggtgttgccgggtggtgggggcgggcgtgtgcgtgggtggcgttcgcggcgggcggtgctgggtgtgggtacggcggtggctgtggtgtcggcggtggttttggggtttacggtgctggcggggaacacgtcggcgggtggtgaggtgtttctccaggcggcggcggaggccgggcccgatccgttcaccgcgtcgacggccgcggagcacgggaacacggaccgtgtgacgcccgtggcggggggtgggagcgcggtggatggcggggactcggcgggtggtgcgcggacgcttgaggtcgatggcgggtatccgggcctgtatggcgggacgcgggaccttgcgagttgtgacgtggagaagcaggtccgctatctcgcgcagaacccggacaagggtggtgcgttcgccggtgcgctgggtatcgggcagtcgcaggtcgcctcgtacctgcggtcgctgacgccggtgcggctggggtgggacaccagggtcaccaatcacgggtaccgcaatggcgggcccaccagctatcaggcggtcctgcaggccggtacgtccgtgctggtcgacggccggggtgtgccccgggtccgctgtgcctgcgggaacccgctggatccgcctgtcgcggtcaggggcgggcaggggtacagcggcgcgaggtggccggcgttccggtcctccggtctcgttgcggtcaggcccgcggtggagccggtggagagtgtcacggtcttcgaccaggaccgcgggggatggtacgagcgtccgggcggggcggcgcggggcaggcatgaccgtgaggtcccgcctccgaagggccaggcctccggttctgcctacccggtcctgccggcggcccacccggcgccggtcccgccgccctcgggcacgtccgggaaccggcccccggggtctgttccgggccaggtgccggaccggccgccgggggagacccccgcccagaacccgggtggcgcgccggtcggcgagccgggtgacatcccgggcagcgacccgggccggatccagggcgatgttccgggccaggctcccggaaaggcgccggctctgcccccgggccaggagccgggcgggggcccggggaagacagccggccgggagtccggcgaggcacccggccgggagtccggcacgggcccggcccaggatcccggtcaggggtccggtaaggacccggggaagacgccggggaagaagccgggtgagggctcgggcaggccgccgggccaggagtccggcacgggcacgggcccggcccaggatcccgagcaggggtccggcaaggaccctgggaagaagccaggtgagggctcgggcaagccgccgggtcaggagtccggtgaggcacccgggcaggttccgggcaaggacccctatcagggctccggggaggacccggagaagaagccgggcgagggctcggtgaaggaccccggtcagggctccggggaggatccggggaagacgtcgggccggaagccgggtgagggctcggaggaggtgccgggcaaggaaacgggccccgaaccaggcaaggcgcccggtcaggacccggcgaaggaggcgggtcagaagccgggccggaagcctggcaaggagtcgggcgaggactcggggacgaagccgggcgagggctcggtgaaggatcctggtcagggctccggcgagggcgcggggaagaagcctggtgagggttcgggcaagccgccgggccaggagtccggtgagacacccgggcaggttccgggcaaggaccccggcaaggaccccggtcaggggtccggcgaggacccggggaagacgtcgggccggaagcccggtgagggctcggagaaggtgccgggcaagggccaggaaccaggcaaggcgcccggtcaggacggggcgaaggaggcgggcctggagccgggccggaagcctggcaaggagtcgggcgaggatccggggaagacgccgggccgggagtcgggtgagggctcggggaagacgtcgggccgggagtcgggtggggagcccggcaaggcgcccggtcaggacggggcgaaggaggcgggccaggagccgggccggaagtctggcgaggggtcgggtgagcaaccgggcagggagtccggccgggaccgggacagggaccggacggggaatggctcgggggatgttccggggcagggctcagcccaggatccggccagggaacctggtcgggagtcggatcaggggtcggggaaggcgcccggtcgggatcaggggccggccggcgatccggcggggggtgcgggtcaggggtcgggcgggggccaggggaaggtgtcgggcaagggttccggctcgggggcgggccaggcccccggcacgggttccgggcaggcgccggagtccggccgcgggtccgggaaggcctctggtcacggcagcggcagggactcgggtccggactcggggagctcgccgggccgtgtgccgggcggcgtctccggggcttcggggaccggccgggagacgggcgggggagcaggcagtgttcccggaacagcgccgggggacggggcgggcggggatcgcggaacggcgcccggggacgggtcgggcgggagttccgggtaggtaccgggccgggatccgggtgttcgctccggtgacggcggtctggggagggcgccgggcctggcggggcgggggaggagcagggcgggggtgcgggctcgcatgctggtaccgcgctgctgacggcaccgtggctgtgggccgggtaagccgtgcttcccggccgggctggcccggttctgtgccgcctggcagggcaaccggcctccgtggtgtcctgcccgtagcccgtagcccgtagcccgtagcccgtagcccgtagcccgtagcccgtagcccgtagcccgtagcccgtagcccgtagcccgtagcccgtaggtcgaaggtcgggcgggtggcaggagggtggccgggtctggccggtatttctgcagtttccgtgcgccgggctctggctgggtggggtgtcggcgcgttgtaccgggccggtgtgcaggggggtggggacgcggttcgggctgagcctgccccgcggtgtgccggtccgggggcgtgtgccggttttcgttgttgctggaaggggaggcccggcggctacggggccggtgtgcagggggggtggggacgcggttcgggctgagcctgccccgcggtgtgccggtccgggggcgtgtgccggttttcgttgttgctggaagggcaggcccggcggccgtggaacggctgcggaccccggcggcacccgctgcccggaccgcacccctggcagccgccccgtggtggtggggcacccggcctctgggggcgaggagaagggagcggccgtgtccggggctgtgggggtgcggccgggtgcggaccgtacgcgcctgcgcccggcgggtggtcggtgcccggcggatggtccggtgcgcggggagcaggtgtgggggtgcacgggtgtggtgtcagcagtgggcgacggccaggctgacggtgtaccgctcctcgatcgtttggtcggggaagatttcggtgagcaggtcttgttccgtggccaggaacgcctgggtggctttctgtccgaggaccaggaagtcggagtaggtggcgaggttcgcgagatgtgtgccgagggggacgctgcgggtccatgacatctgccgggtggtgaaggtgagttcgggtggcaggtcgcggaaccgggctgtcggatcgggttggctgtcggcggctccgaagaggcggcgtaggcgggcgtcctggtcggcgatccaggggagcgtgctgtcggagtcgttccaccacagggcgagcgcgccgccgcggcgcagcacccgctgggcttgcgggacggatcggcgcgggtcggtccagtgccaggactgggcgtaggtgaggatgtcgatgcagtcgcgggcgaggggcaggctgttgccgtcgccgagtacgagagggatgtggggcagcctgcggcggaactgggcggccatggcggggccgggttccaccgcgacgacgtgtgcaccgcgggcatggaggagggcggtggccagtcccgtgccggcgccgatgtccgcgacgcgggcgcccgttaagggccggccggcgagttcctcgacggcgtcgaggagggccgggggataggacgggcggttttcggcgtagccggcggccgctttgtcgaaggacctggcctgaggggtgagcgtcatacggccatcctcaccggccgaggcgtccggcgcactgccccgccccggttcccccccccgccccggtgggttcttcctgccccggttttcccgcccaggttccttgcccccggttcgtcctgctgtgggcggcgccggccgtgggacggcaggccacgtcggctcgttgagccggagctgccggccccggcggtcccgtcggagacggtggcgcgggcccggcgtgcagtccttcccggcgggcggcgatccagccgtggccttcgccctggccccccgccgccgccgggcatccggcgctggggaggtggacacacccccggcaccggcccggcgtccccggcacgcagtccgctccgacgcaccacgcccggcacgcggtccgctccggcgcaccacgcccggagtgccggccgctccggcgcaccgcgcccggtgtggcggctgttctggtgttccggggccggtgtgtacggtccttgtcctgcggcgggggctgccggtgtccgttcggtgccgggcggtcggggaatagtgtcagccgggtggcacgaaccaggaccagggccagggccagggccggggccggggccggggccggggccggggccggggccggggagcgtgcgtgttccgggtcgcgggacggctccgtggtcctggcggccggtgtccgggcggggtgtggcggcaggaccggagccgtccgggccgcctgtcggtttcggtgcgggccctgtgggcgggggttgttccaggggcgccgctggttgtgttcgggggtacccgtcgtttcggtgcgtgtcccggcggcagggttgttcagggccgtggttcgtcccgttctgggtggtggagttgagtgcagggccgtctgtatgccgggtggccgtccgtcgggtagctgtccggccgtacccgtacccggggctttgtgccggccggggccgggtggacggtggtgggcagtggtggacagtcaccgggcctgcgggggctggagagtggacgccgttcggcgggagtgtgtgtcccgtgaaggccgcccgtaccgcatggacggggctgcgggccggtgtccgcggccgggaccggttctgccgccggcccggcggccggagtcccgtacctgcctggcgctgtcgcgggcagggcccacccccacccgtacccgttcccgggcttgtgcccgggtctttgctgtcaggagtttccgtcatgacgtcccgcacgctgcgtactctcaccgtggtgaccgctgccgctttcctgtgcgccaccgccaccgccaccgccaccgccgccgccgcttatgccgtgcagggcaccggccggccggttcccggggtcgttgccgcctgggcccgtgcctggaacggcagtgatccccgggccctgggcgcggtgttcaccgccgatggcgtctacaccgacgaggccgtcggtgtcaccttccgcggccgtaaggagatcgcggggtggaaggcccgcgccgacaccctcatcgacaacgtccgtgtcagcgtccgtgacacccgcctcgagggtgaccgcgtcaccgtacgggcggtctactccggccatctcaagggcgcgcccaagccgttcgccgtgccgatgacgaccctgctcggcctcgacagggggcactgccggatcgcctttgaccaggaccactacagtctggccgaggtccttatccagtccggcctgcctgcggactggaccccgcccgctcctggcgcggccgcccgctgaccggttggccggtgaccggttggccggtgaccggccggtccggtgatccggtgaggaggccggggagttcgcgcatgtcggtgaagacgacggtggcggggcccgtgagccggtgcggcggggtgagtccgcccgcgtaggccagggcgcgcatcccggcggcgcgggccgccaggacaccggggaggctgtcctccacgaccacgcacgcggcggggtcggcgcccatctgccgtgccgcgtgcaggaagaggtcgggggcgggcttgccgcgggcgacctcggcggcgctgaagatgcggcccgcgaagcgttcgtagagccctgtgacaccgagggtgtggcgcatcttgtcgtgcgagccgctggaggcgacgcagaccggcagggtgatctcctccagtgccccgggcagcccgtcgaccgcttccagcccggtgtccactgcctcccggtggcgccgcaggagctcctgccaccagagggcggccgtctgcgggcccagccgctgcgcgatctgttcgcagatcgactccttggagcgtccgatgaaccggtcgacggcgtcctcgggggtcagcggccagccgagttccgctcccagggcgagctggatgcgcagggcgatgcgttcggtgtcgacgagtaccccgtcgcagtcgaatatcacgagttcggccggcttgatcatcccggcaggataaggccccccgcctcatcctcccggggcccgtagccctcccggtgcccgccgtatcccttccggggctgccgggtgcggacggcccgccgtacgcgccgtacgcgcctacgtgccgtcgcgcgcggtgcggaccggaccggaccgggcccggcgggcggggggggggcttcagtgggcggggtgccttcggggccgtggggacgggggagtgcccggccccaagcgcccggagtgcagtgcgagcccggcggcgacggcggccgccgcgacagccgccgccgcgacggcggcggtggtggggccggctgtcaggaagccgttgcgtgagtgccaggacagcaccgaccagcgggaccgcgcggacagcagcgagcccgtgctgagccaggaggcggcgcagagcacggacagcgacgatccgacggaggcggcggacagggcgctgcccgcggaggcgatcgacaggactgagcccaccgagccgatcgacaggactgagcctacggagccgatcgacaggaccgagtccttcgaccagagggagaggaaggagccctcaccgcggcatccggggtccgtccgtgcatgagatccggtcacggggtcatcctgacaggcgggaaccctcaagggggccggtacccgccgggcggcggccgcgcgccgcgccgtgcgccgcgccgcactggtccggggagttgcgggggtttgcggggtgtgccgcgggggtgggcgggcggagccgaccggaatcgaaccggtgtcctcgcgattttggagaccgcgcgcgtcgacctctgcgctacggccccgcccgtcccgggatcctaccggtgccgctcccggccgccgcggcggccggaacaggccaccgccgccccgcccccgccccgccccgcaggcagcctccccggtccgcccccgcgcgccgggcccggcggtaacccctgccggtaccggaggggccggggccgggcccggcgcgcgggggcacgcgccggccgggcgtggggtgctgcgagaacggccggttatcgctcctgcgccgggaacgcggggcgtgttcccggcggttcaccggagggaaccggggccgggcccgcacgacccgccccgaccggcaccgatggcaaggagaaaccgtgcgcatactcttcaccggaccggccgcggccggccacctcttcccgatggtcccgaccgcgcaggcgttacgcgcggccggccacgaggtgctgttcgcgggctcgcagcccctcgaacagctccgcggggccggtttcccgatcgtcgagatcggtgacggccgcagcatccgggatgtcttcgagggggccacggagcaggaagtgcggtacgtgaccccggacatgagcacggaccagatcctggaccgggcggcccgcggtttcgcggtggtctcccgttcgaccgtggagggtctgctggaggccgccgacagctggcgtcccgacctgctggtctacgactccttccaggcctcggccccgctggtcgcggccaaactcaagatcccgtcggtggtccacaacttcggtgtcacctccggcctggacatggtcgcccggctcgccgccaacttcaccgaggcgtacgcggcgtacggggtggacggcccggccgtgccgaccgcgctgaacgtcgtcccggcctcgctcggcggcgacgcgcagggcctgcgcatgcgctacgtcccctacaacggcggcggcgccgtccccgccggcctgctccggcgcggcagccgcccgcggatcgccgtcaccctgggcaccgtcctcaccgagctggacggcgtccgcgccatcaccgccctgaccggggcggccgcgtcggtggacgccgagttcctgctcgccgtcggcgacgccgacctcaccccgctcggcacgctcccggacaacgtccgcccgctgccctgggtcccgctcgccgagctgctgaccacctgcgacgcgctggtccaccacggcggctccggaaccctcctcaccgccctgcaggccggcctgccccagctcctgcttccccagggcgccgaccacttcgccaacgccgacgccctcaccgccaccggggccgggctgcgttcggcgtcccaggacgtcgacgccccgctcctggcccgtctggccgccgacccggcgctgcgcgaggcggccgcccggctgcgcgggcagaacgcggccctgccggccccggccgcgacggtccccgccctggaggccctggccgccgcctgagaaccgcccgcccccgcacccggccggcgggcccggacgggccgccggccgggtgcggggcggctcagccgccggccagggtgccggcgaggaggggcagcagccggtcccagtggcgctgcagcccggcgggatcgaaggcgtcggtgtcggacatggtgaagccgtggacggtgccggggtagatctccgaggtgtgggcgagccccgcggcgtccagggcccggccgagttcaccgagggcctcgggcgtgatgtcgctctcggcgtggccgagatggacccgggcggtcagtcccgccaggagacggcgcaggtccccgggcccgccggcgcccacggggctgtggaatccggcgacggcggccacccggccggggtgcgccgctgcggtctgcaccgccaggaggccgccgatgcagtacccggtcaccgcgaccgggccggggccggcctcgggccgggcggtgaggaacgtgaggtaggcgtcggcgtcacgcaggacccgttcggtggtgtgcgcctcgatcaggggcatcagctgggcgaggagcgcgggccggtccttgtcggtgatgtgcccgggaaggccgatcaccggtgccgggccgtgccggtagaagaggttggggacgagtacgtagtagccgtgcccggccagttcgcgggccatctcccgcaccacgggccggatgccgaagccgtccgggtacatcagcacccccgggtggcgttgccggccggcatcgtcggggaaggcggcgaaggcgtcggccgggccgtccggcgtgggaatcgacaggttctgtacgggcatgaatcctccggttgcggtcgtcgtgtgcagcctgtggtcgacacgacgcaggcggggcccgcgcggccgtggcggcgcggccccctcgcccgtacagagggcgggacagagggcgggacagggggcggacacgggcaccggcccgtccggcgctcagcggagcaccgggtcaccgatccgtgtgtggcgcaatgccgtcccgggagtcatctcgcccaccctagccgccggttgcggccgcccgcgagaacaattccaccccggccccgcccttcgggcccgcccttcgggcccggccccggcctccgcccccggccgccctccggggcccggcctcccggcccggccccggacacgcccgcctcttaccggaccccgcccccgcctccggccggcgttcccggcctcgcggcagccgccccgcgccccggcctccggccggcgttcccggccttcgcggcagccgccccgcgccgcggcccctacacccgcccgcgcaccccgcccgcccgcgtcccgtccgcgaggcccgcaccccgcccgcaccccgcccgcaccccgcccgcgtcccgcccgcccgcgtcccgccgtgcgtggccgtgcgtggccggaactcgcccggggcgggtgaacacaggcctacgtactggtaacttacgcgagttgatcaaggtcggggtgtggccggccacgctcccggccggagccacccccaccccattcaaggacccacattggcacgcaccgtccgtacggcggccccggcggccctcgtccccgccacggccctcgccctcggcctctccctcctcggcgccgccgccccggcgtccgccgcgcaagcccccaccccgcacctggactcggtcgagcagaccctgcgccaggtctcaccgggcctggagggctcggtgtgggagcgcaccgcaggcaaccggctcggctcctccgttcccgggggcgccgactggctgctgcagacccccggctgctggggcgacgccgcctgcaccgaccggcccggctcgcgccgcctcctggacaagacgcgccaggacatcgccgccgcccgcgagacggtggacatatcgacgctggcgcccttccccaacggcggctaccaggacgcgatcgtcgcgggcctgaaggaggccgtcggccggggcggccggctcaaggtccgcatcatggtgggcgccgcgcccgtctaccactccacggtgatcccctcctcctaccgcgacgaactgctcgccaggctcggcccggaggccgcggccggcatcaccttgaacgtggcctcgatgaccacctcgaagaccgcgttctcctggaaccactccaagctggtcgtcgtcgacggcacctcggtgatcaccggcggcatcaacagctggaaggacgactacctggagaccgcccaccctgtcagcgacgtcgacctcgcgctgaccgggcccgccgccggctccgcgggccgctacctggactccctgtgggactggacctgccgcaacaagagcagctgggcctcggtctggttcgccgcctcgcccggcgcggactgcatgccctccctgccccgcccggccgccccggcgggcggcggtgacgtgcccgccctcgccgtcggcggcctcggcgtcggcatccgccgcagcgaccccgcctccgccttcaacccggtcctgcccaccgccggcgacacccggtgcggcatcggcgtgcacgacaacaccaacgccgaccgcgactacgacaccgtcaaccccgaggagagcgccctgcgcgccctggtctccagcgcgacctcccacatcgagatctcccagcaggacgtgcacgccacctgcccgccgctgccccgctacgacgtgcgcctctacgacgccctcgccgccaagctcgtctccggcgtcaaggtccgcatcgtggtgagcgacccggccaaccgcggcacgatcggcagcggcggctactcgcagatcaagtcgctctccgaggtgagcgacgcgctgcgcggccgcctgacggccctgaccggcgacggcacccgggcccgcaccgcgatgtgcgagaacctccagctggccaccttccgcgcctccgaccggcccacctgggcggacggcaagccctacgcccagcaccacaagctggtctcggtcgacggatcggccttctacatcggctccaagaacctgtacccgtcctggctccaggacttcgggtacgtcgtcgagagcccggccgcggcccggcagctcaccagcgacctgctggacccgcagtggcgctactcccaggccaccgcgacccacgactacacccgcggcctctgccagggctgacacccccggccccggcgttccgccgcacccgcagcacccgccgcccccgcggcacccgccgcccccgcggcacccgccgcccccgcggcacccggcccccgcggccgggtgccgcgggggcggccccgtgcccgccgccgggaataccgcgggcgcgccccccgttccgggtatggttgaacagtcaacaatcttggaaggggatggggacccatgcagttcgggatcttcaccgtcggcgacgtcaccgccgacccgacgaccggacgcgtgcccggcgagaacgaacgcatcaaggcgatgctcgccatcgcgcagaaggccgaggaagtcggcctcgacgtcttcgccaccggcgagcaccacaacccgcccttcgtcccctcctcaccgacgacgatgctcggctacatcgccgcccgcaccgagcacctgatcctgtccacctcgacgacgctgatcaccaccaacgacccggtgaagatcgccgaggacttcgcgatgctccagcacctcgcggacggccgcgtcgacctcatgacgggccgcggcaacaccggacccgtctacccctggttcggcaaggacatccgcgacggcaccgacctcgccgccgagaactacgccctgctgcgccgcctgtgggacgaggacaccgtcacctggcacggcaggttccgcaccccgctgcagtccttcacctccaccccccgccccctggacggcgtcgcgcccttcgtctggcacggctccatccgctccccggagaccgccgaactggccgcctactacggcgacggcttcttccacaacaacatcttctggcccccctcccacaccgcacagatgatcagcctctaccgcgagcgctacgcccaccacggccacggcacccccgaacaggccgtcgtcggcctcggcggccaggtcttcatgcgcaagaactcccaggacgcggtacgcgagttccgcccctacttcgacaacgcgcccgtctacggccacggcccgtccctggaggagttcacctcacagaccccgctgaccgtcggctcgccgcagcaggtcatcgaacgcaccctgtccttccgcgactacgccggcgactaccagcgccagctgttcctcatggaccacgccggcctgcccctgaagaccgtcctggaacagctcgacctgctcggcgaggaggtcgtaccaatcctgcgcaaggagttcgcgaacctgcgccccgccggcgtaccggacgcgcccacccacccggcccgcgtcgcagccgcccggcagaccccggcgggggacaggcgggcctgagccccgccggggcctgccggcggaaaggcacgggcccccggggcgcggcggctgacgccccgcccgcccctcacacccccgccacggcaccccggggcgggacggcgcacgccggggcggcgccggggcgggccgggtcagcggtcccggtccaggagcagcggcaggtcgttgcgggtggtgacgccgagcttggggaaggcccggtagaggtggtggccgaccgtgcgggggctcaggaagagccgggcggcgatctgacggttggtggcacccgtggcggcgagccgcacgacttcccgttcctgcgggctgagccggtccagcagctcgtcccggcgccccgcgggatccagcgtctcaccgcaggcctggagttcggtgcgggcccgtgacgcccaggcccgggcaccgagcccctcgaacgtctccagggcactgcgaagacggccgcgggcatcgctgcggcgccgttcacggcgcagccactccccgtacagcagctcggtacgggcccgctcgaacggctgggccgtgccctcctcgtgcagccgcagcgcggccgtgaagtgctccccggccccggcgcccgaagaggtcagcgcctggcagcggcgggccagggcccaggccgccggctgctgcgcggccccggcccaccgcgtcatgaccgcgaccgcgtgcgccgcgcgctccacctgcccggcccggaccgccgcctcgaccagatcgggaaggaggaaggcggtcaggaccggatgccccgcccggtccctggccgcctccaggcgggcgagcgcgctcccggcgtccccggcgccgaggtcgagcaggcccagggcccgcagtgcgtgggcggcggccagtccgatgccgtgggcgtcggcgtgctccagagccgcctcgcccaggccggtgcaccgctcgtgatcgccttgcagcgcggccagcgtcgccagggtcgcccgcaggtacgtctcccggtgccggcggccgaactgcccggcgacggccagcccttcctcggcggcggcccgggcctcctcgtggagccccagcgacagccgggcctcggcgagcaggtgcagcgaggtgtggagccagccgaccacgtcctgggtccggcagtcgcgcacacaggcggcggcggtgtcgagcgcggcgcggtgatcggcgaagagcaggccgtgcaccccggccaggatccgctcggcgaacccgtcctccccctccccgtccccgtgtcccgcgtgcggcagctccgctgcccccgtccccggccccggccccggccccggccccggcgccggctcccggaccgcgtcgagggggccggtcatcgcccgggccatcgcgtactgcggggagtcggggaggcgggcggcgacatcggccagcagccggcggtctcccgaggactgcgcgctctggaccgcctcggtcagcaccggggccaggtcggcgcactgcccgatccggtccgcgcactccagcaggatgcgggcggcccggcccggtgacccgcggtcgagctcgacgatggcccggacccgggcgaggtcggcgagcatccgcgggtccagggcgagcgcgttgatgtggtcggtgagggccgcggtgcggtggaactgcccggcctcggccgaggtgatggccgcggcggccagcagctgggcacgggcggcggggtccacggtcagctgcgccgcccgttcgtacgccgccgaggccgaggccgtcccctgccggccgcccgcccgctcggcgacaccgaccatctcggcggcgacggcctcgtcggcgccggtcgtggcggccgccaggtgccaggccctgcggtcggcgtgctggccggcgccccggtccccggtgagcgcgtcggccagcgcccggtgggccgccagacgccgcgccagggccgcgtcctgataggtcgccgaccggatgagggggtggcggaaggccagggtgtgctcgctcagcaggaccagcgtggcgtcctcggccggctccaggtcctccagcgcggcaccgaaacgggccgacgcccgcagcaccagatcgaggtcgccggagtcgtcggccgcggccaccagcagcatcgcccgggtcgcgtcgggcagccggcggatctgggcctggaaagcctcctggatccggctggagggcgaggacagcccggccggaagagcgacggggttcagctgcccgccgcgctgctcggccgtgagcgacgccggcagctccagcagggccagcgggttgccctgcgcctgctcgacgatctgctcccgcgcatacggcgacagggcgaccacccggtcggtgagaagggcgtcgacggccgcggaatcgagcccccgcagcagaagctgcggcaagccgccgatatgccccccgggcacaccgtcacggaccgcgaacagcatcaccacaccctcacggtgcagccgccgggccgcgaacaccagagcgtccagcgacgcccggtccagccactgggagtcgtccaccacacacagcagaggaccgccgcccgcggcctgcgacaggatcgccagcaccgccgtccccagggcgaaccggtcccgcaccgcctcacccgacaccccgaacgccgcgctcagcgccgcggcctgcggccgcggcagccgctccagcagcgaggcgacgggccacagcaactggtgcaggccaccgaaggccagctccatctccgactcgatccccacggtccgcagcacccgccccggacccgccaaccccctcgcgtactccagcagcgccgtcttgcccatcccggcctcaccatggatcaccagcgcaccgctcgccccgcccgcaccgtcgccgtcgccggctccggcacgcacaagcatccgccgtatccggtcctgctcggtcccccgcccgtaaagcatggggccaacctacctaacgcccccgcgttcgtgatcaacgcgttaagtcacgcctaccgatgtgccggcccgtcagacccccgtaactttccgggagtcagcccccgccgatcaccggagccgccgccttgtccgagcacatccacctcgtccccctccaccacgtgtcggtcaccgacgccgccgcctggcaccgggtcgtcgccgcctccgcggcccacgacacaccgggaacaccccctccggaacccgccagcatccacgcccggctcaccacgcccgccctggacagccaccggctgacctggctggccaccggagccgacggcgccgcggtcgcggtcgcggccctgcggctgttcacctccccgggccgggaccacctggccgaactggaactccacgtcgaccccgcgcaccggcgccggggaaccggctcccgcctgctgtccgccgccgtggcggcatgccgcaccgagagccggcgcagcctggtcgccgcagcggcagccgacggccccggcgaggccttctgccggcgctggggattccgcccggcgatgaccctggaccacctcctgctgcgcctcggggacaccgacgggcccgcccaccgcccgccggccgacggcggaccccccggctaccggctgaccggctggaccggcaccgtccccgacggcctcgccgacgccttcgccctggccaagaacgcgatgaacgacatgcccctgggcgacctggactacggccacgaggcctgggacgccgcccgcgtccgcgccatggccgaggcggtcgccggccgcggcgacaccctgctcaccgtcgccgccctccacgacgacggcaccatggccggctacaccgagatcgtgctccccccgggaacaccggcccgcgcccagcagtacgacacggccgtcgtccccgcccaccgcggccacggactgggcctgtgggtcaaggccgccatggtgcgcaggctgcgcgccgagcaccccggcgtcaccgagatcgagaccgacaacgccgaggacaacctccacatgctcgccgtcaaccaccggctcgggtaccgcacccaccggcgcacccgcgagttccagctcggcctgcccgcgacctgaccccgcacccgtacccgccgcagcacccgtacccgcatgaacccccttaccggcacccgcatccgcacagaagaagcgagaaccgcttgcgcaagctgacctgctacatctccgccaccctcgaccgggccgcccagcggttcgacacccccgccgccaaccgccgccccgccgtcctcggctacggcatccccctcctcgaccgccccggcacccccgcgaaccccgcccgcacccccgccccggccttcgactgcggcctcaccgtcaaccacttctccagggggctgtcgtgaacgccaccgcctccacccccgccccggccgagacggcgacccacaggaagaagagcgaccgcatgcgtgtgctgctggtggcgtacggctcgcgcggggacatcgagccgatgctcgcactcgccgcgcggctgcaggagtcgggcgccgaagtacggatgtgcgcgccgccggacttcgccgggccggccgaggacgccggtgtcccgctgacacccatcggccggccggtgcgcgagatggtcaggggagcggtgaccgggacggcgccgatgccggcgcaggggctgcccgagcgggcggcccggctggtcgccacgacgtacgaggcggtcgccacggcggcccgggggtgcgacgtgatggtggcgaccggcctgttcccggccgcggccggcgcgcggtcggtggccgaggaactgggcatcccctacgtgttcgtggcctgcttcccgacctacctgccctccccgcaccacgctccgctggcgcggccgggccaccccctcccgccgcaggcgagcgacaaccgggcgctgtgggacctggacgccgagaacctgaacgcgctgttcggcaccgggctcaacgcccaccgggccacggtcggcctgccgcccgtggacgacttccgcgactacgtcctcaccagccggccgtggctggcggcggacccggccctgggcccgtggaaggagccggccgacctcgacgtcgtgcagaccggagcgtggctcaggccgggcggacgcccgctcccggccggcctccaggcgttcctcgacgccggcacaccgccggtgtacgtgggcttcggcagcatccccgtccgcgacgcgcagggcgtcgcccgggcggccgtcgaggccgtccgcgcacagggccaccgcgtgctcctgtccggcggctgggccgaactggccccggtcgacgaccaggacgactgcttccgtgtcggggaggccgaccaccacaccctcttcccccgggtggcggccgtcgtccaccacggaggcgcgggcaccacgaccacggccgccctggccggcaccccgcaggtggtggtaccgcagatggccgaccagccgtactgggccgcccgcgtcgccgagctgggcatcggcgcggcgcacgacggagcggacccgacccgcgagaccctgtcggccgcactcgcaacggccctggaccccaggacccgggcacgcgcgaaggccgtggccggcctcgtccgcacggacggggcgacggccgccgcgcaactgctgctcggcaccgccggctgacagaccccgcccgcacgccgcacggacgcggcaggcacggaagcggaagcgccccggtacggagcgcggccgcgtccggcctggggggtgtcctgccggtcagggcggatcagggagcggcgcccggcaccgcgccccgccgcgctgcccccggtcggcgacgctccgcgtcgcctccctcgccctgcgatgcttccctcggccctggcgggcctggggagaccccacggcaccggccgccgctccctgatccgccctgaccggcaggacaccccctggggcattcccggatccccggcaccctcccgcgccgcccgggcccgccgcccgcccctttccccgccgccgctaccctgcgcaggcggcgcgggagccgcgggaggcccgcgcggtgcgggcacccggacaccgaagcggaatccgacccggggcacgcgcaccaccaaggacacccccatgacgtggcagtggaccggcctggccgtcttctccctcaccctgctgcccgcggcggcggcgatgatcgccgaccgggtgccgcgccgcctgcgcaggaggccggcgcccgtgcgcccgcgcggctgggcctcctgctgatctgcgccaccgcccccgtcaacgccctgccccgcctcgccggggcctcgcccggcctcaccctggcctgtaccgccgcgggcggcggcctcgcggtggccgggtgcctggtgctgggtgccgccgtcctctggcgcccgcgccgcgccccggccgcgcccccggaaggggcctggcgcccggccccgcccgcggccgccgggccggccggagccgcgggccgtacgcgacgtgccccgtcacaggcctgtgacagtcggcggaccgccccgtgaagtcccgcggccaggctcttaacaagagggcaaagcggacattccgccttcgttctcgggaaccccccaccgcctcccgctctggagaactcctcatggcccgcacttcccggaagcagcgtttcgcgatgttcaccgtttcggccgcgctcgtcacaggaggcgcactggtccccaccagcgcattcgccgcccagaccacgccgcacaccgaggcggccgcgttcgcgtccggtcacggcgaccacacgaagagcgaccaccgaaacgcggccgaccaccacgagcacggcggcaaggacaggtcgaagggcaggaagaacaagaagccccgggacgtggagaacatgccgggctgcaagttctaccagggcaaggtctactgcgagcacaagcccgacacccccaagcccgccccggccggcccgaagcccgccccggccccggacgccgccgaccgggagaacccggaccgggtcccggctcccggcgcggacgggttcggcatcgaactgggactctgacccgcggtccgcccgccgcggccctccaccccggcggggtacggcgccgcgcaccagcaccctgcgccgcctccggccccctccggccgcacccggccggccggcccgggcccggcgctctccgcccgcggcccggcccggagaatgccgcggtatgaactcccagtcaccgccgggcccttcacgccgggcgctccgcgtcctgcggcgctacccgcgccgggcgccgctgaccctcgcctacctctgcctgctcctggccggccacgcctggaccggccacgtgctgtccgccgaccgggcggccgccgtgctgggacacctcagcaccaacctggacaacctgcgggatcatccgctgtccgcgctcctcggcagcgcgctgttcttcgacggcaccctcaccgacgtcacctcgaccggcttcgcgggcaccctgatcaccctgggcctgggagtctgctgcttcctggcctggaccgagcaccgctggggaaagacgcgcgccgtggccgtgtttctcggcgggcatgtcgcggccaccctgctcaccgccgccgtcatcaccgtcgccctgcgccacggccgctaccccgaggacgtgcggcacgccctggactacggggtcagttacggcgcccagaccgtgctggcgctcggcacgctcgccctgccccgccggggccgcctgccctgggccgtcttcgtcctcgcctggccgctcggcggcgccgagtggagcgggccgctgccggacttcaccacgatcggccacctcacggcggcggccctcggcttcgccctgctggccgtcccggccttcagacggcggccggtccgcgccacccggctctcctccaccgcgagctgagcccgggtcacccgggcggcggcccgcaccccgggggaagcgtcaccgtcccgggccggtgcccgaaggtgtccacgaccagccactcgactcgtccggctcggggtcgtagaggttccggacaccgaaccgcagcacctgccagaaggtgccccggtcgccctcgtcgacgcagatgtcgcccagcgcgagcggcagccgcgggtgattccccgaaggcagccgcgggaagaccacacccacccgccggtggttcacctgccgcggtccgaaaccggcggccaccggccccgccaccagggcccgccacccacgggagcccccgccggagaggtccggcgggggctcccgtcacggggcgggacacgccgctctgtcagccgatcggcaccacttgctcggcctgcggtcccttggggccctgggtgacgtcgtactcgaccttcgcaccctcggcgagctccttgaagccggtcgtctggatggcggagaagtgcacgaacacatccgggccgccgtcgtcctgctggatgaacccgaaccccttctccgagttgaaccacttcacaatgcctgtagccatcggcgtccttctcgatcggtcatacgggccgcaggtgcgcagccgtcccgatcgttcccacccgccccccaccccacacccccgatgcagccatccggccgtcacacccccaaccgtccacccaaccgtccaccccggccgtcacacctccggcggtcacacccccggcggtacgccccgccgccacccgcgggcccggaccgcaggcgggctcctacgacagggccgccgccccctcctccagcaggcgggccgccatcgcccgcatctcgaccttgcggatcttcccggtgaccgtcatcgggaactcctccacgacatggacgtagcgggggatcttgaagtgggccaggcgccccgcgcagtacgcgcggaccgcctgcgcggtcagcggctcggccccctcgcgcatccgcacccacgccatcagctcctccccgtacttcggatccggcaccccgatgacctgcacgtccagcacgtcggggtgggcatggaggaactcctcgatctcgcgcgggtacaggttctcgcctccccggatcaccatgtccttgatccggccggtgatgctcaggtatccctcaccgtccatgacggccaggtcaccggtgtgcatccagccctccgcgtcgacggcctccgccgtcctggcgggctcgccccagtaaccgagcatcaccgaataaccccgcgtgcacagttcccccgcggtgccgcgcgcgacggtccggcccgaccgcggatcgaccaccttgacctccaggtgcgggccgacccggcccaccgtggagacccgccgctccaccgggtcgtccgcccgggtctgcgtggacaccggcgaggtctccgtcatgccgtaacagatgcacaccccggccatccccatccgctcgatgacctcggtcatgacctccaccgggcacggcgagcccgccatgatcccggtgcgcagactcgacaggtcgtacccgtcgaacccggagtcggccagctcggcgatgaacatggtggggaccccgtacagggaggtgcacgcctccgcctccaccgccgccagcgtcgccgacgcgtcgaaggcgggcgcggggatcaccatcgccgcaccgtggctggtacaggcgaggttgcccatcaccatcccgaagcagtggtagaacggcaccggaatgcacacccggtcacgctcgtcgtatccgcacagctcacccacgaagaagccgttgttgaggatgttgtggtgcgagagggtggcccccttggggaagcccgtggtgcccgaggtgtactggatgttgatcgggtcgtccgcgtccagcgcggcctgcgcccgcgccagtacggccggatcggccccgcgcccgcgttccagcagcgcgtcccagcgcggcccgtcgaacagcacggtgaactccagccccggacaccgcggccggacctcctcgatcatcgccgcgtagtcggaggtcttgaaacgctccgccgcgaccagcagccggatcccggactgccccagcacgtactccagctcgtgcgagcggtacgccgggttcacggtgaccaggatcgccccgatcttcgcggtggcgtactgcaccagcgtccactcgccgcggttgggcgcccacacaccgacccggtcgccccggacgatcccgaggtccagcagccctagggcgagcgcgtccacgtcggcggccagctccgcgtacgtccaccggcggccggcggccacgtccaccagggcgtcccgcccgggaaaacgccgcacggtccggtcgaggttgtccccgatcgtctcgcggagcagcggaacctcacaactccccgacgcatgactcgacgctgtggacacacgtacctcctgcactcgctgcggcgatgacggccaacgcgcgccgccatgatccctcccggaggaccgcggcaccagacgcgcggcccgccgcagcaccccaccgcacaccggcggcgggctcagccgccggtgcggagctcgtcgatccgctccgccagagcctgcgtctccgcgatcagccgcgcgtgcgccttcttctgctccccgtcgccccgggccctgaacgccccgctgaagtgcggctggagctgggtccaccagccgtagtccagcatcgcccacgcctgcgggcacaagggggcgcggctcttggggaggtagccgccgtcgaccagcggcttccggtaggtgcccgggtcgctgccttccagatagcacaggaaggtgaagacccgctgctgggtgacgggatggtcgctcgccaggttctccagggtcagccggccctccttgcgggcgatctcgtcgaagagcatcgcggcggccagcgacgggcccggcccgacctcgttgacggtgtagaaggacgcgaagccgtcggccgcgtcctcttcgagaccgaggttggccagcaggagctggcgctgcagggcatggcccagctcatggccgaagatgaactcggtcgacagcacggtcagatcgccggtgttgtactgggacgcggggaatggggccggccggtcgacgcccttcacgacgtcggcgagggcgtcctcgacctcgaccaggaacgccggcgggatgaagatcgtcctgccgtcgggctgggtgacggcgtcggtgacacccggcggcacctcggcggtcaccttcacgaccaggtcgtgcggcaggacgagcgccccgccgacccagccggccgcccgctccagaacaccggagttccggatcagcgccacgacctgccgctccttgggccggagcgccttgtcctcgtagacgacgctgaccctgccggaacgcgccgcccgggcacggaccgcggcccccggcccctgccccgcgtcgccggcccccgcgccgcacccgctcacggcgacggcggccaggaccagcacgcctgccaggacgccgcgcgccctgctcgaacaaccggcggagttcgccatcctggtcggctcccgtcacccgttcccgcgcccatcctccggccggccgcaggccggggcccgccggaccgtccgtccgggggacccccggcccccgaccgcgctcacccccggcgccgccgggcaggcggcgccgggggtgagcccgttcaggagacggccgcgccgggccggtcgtgcggcgccccgccgccgggcgtgcggcggcccccggcggaggagacgagggcgtccgccacgaccgccgcctccgcgtccgcgacatccgccgggtactcgggcagcagatcgtcccagacgggcatccacgacccgtacagctgggtctggccctcgggccgggcgaagaaccagatgtgcaggtgcgcgcccccgtccccgatgcggtacacgtgggcccgcgcaatgtgcggcagggcctgcacgtggcggacgacgtgcgcggacagcacccccagctcggccgccagcccatcgggcaggtcggccatgtcgtagtgctcacgcggatgcagcatcagcaccagcggcaccccgacccccgtgacacgggtgagccgccagcggtcgttgaaccagatcccggcgtcccgctcacggcacgcacggcactgcgcgggatcctcgccgtgccgcgggggctcgggcacgaccggggggcgcagcggcgcgatgcgcagcccctccggttcgaacgggctgatgtcccaccccgtcatgcgtgcgagcggcagccgccgctcgtcatccgcggcggcgagcgcgtggtcgtagaactcatcaggtcgtaaagccatgccccgcaggctagtccggggcccgcgcccgcccgcgggccggggccgtccccggcaccggacggcggaccggcacgccgcccgggggcgcgccggtcgcgggcgccggccccgggcgggggtacgttccgccgcatgcgatctcatgacctcgtgatcgtcggggcgggctccggcaacgccgtcgtcgacgaacggttcgcccacctggacgtggccgtcatcgacgaaggccccttcggcggcacctgcctgaaccgcggatgcatccccagcaagatgctcgtacacgtcgccgacctcgccgacgggatccgcgacgccgaccggttcggcgtgcgggcacggctggacggcgtcgactggcccgccgtacgcgaacgcgtcttcggccgcctggaccgcgaggccgccgagggcgaacagggccggcgcgacgacccgaacatccacgtgctcaagggacacgcccgcttcaccggcgagcgcaccctgctcgtcaccaccggcgccggcaccgtcaccctccgcggcgagcaggtcgtcctcgccaccggcagccgcccggccgtaccgccaccggtacaggaaagcggcctgccgtacgagacctccgacaccgtgatgcgcctggagaggccgccccaccacctggcggtactgggcggcggctacatcgcggccgaactcgcgcacgtcttccacgccgccggcagccgcatcacactcatcgagcaggaggacaccctgctctccgcccaggacgagagcatcgccaccgcctacacgacgatcgccgccgaccgctacgacgtacgcaccggcacggccctgacccgcgtcgagggggagcccggacggctgcgcctggtcctggacgacggcacgacggtcgaggcggacaccctgctcgtcgcggtgggccgcacccccaacagcgaccggatcgacgccgcccgggccgggatcgacctccacgacgacggccgcgtcgtcgtggacgccttccagcgcaccaccgcccccggggtgttcgccctgggcgacgtgtgcacaccgttcccgctcaagcacgtcgcgaaccgggaggcacgggtggtggcgcacaacctgctgcaccccggcgacccggtccgcacctcccacgaggccgtccccgcaggggtgttcacccgcccccagatcgcacaggccggacggaccgagcagcagtgccggcaggaaggactcgactacgccgtctccgtacgccgcttccgcgacaccgcctacggctgggccctggaggacggcaccggcttctgcaaggtgctcgcggaccgccgcaccggactgctgctgggcgcccacctcatgggcccgcaggccgcgaccctgatccagccgctggtggtcgccatgagctgcggcatcacggccggcgacctcgcgcggaccccgctgtggatccaccccgcgcccaccgaggccctctccaccgcactcctcgacctcgacctcgaccccggcgccgaccccggcggacgcccggagcggccctcgtaaagcaccgcggcccgcccggcccgccccgcgggagacacgctgcgcgcacgcgtcaggaccggcgcccccggcaaggtcgccaccggcgcagacctcgtacgacgcctcgtccagggcgccgacttcacccactcggcccgcgcgatgatgttcgccctcggccgcctccgggcccagcgctgccacaccagcacccgccccgtcggcgtcgccacccaggacgcgcgccgcgcccgcgccctcgacgccggcgacaagtcccggcgcgcgcaccgctgccagcaggcgaccgtcgacagcgcccggcagatcacggcggccacgggcgtcagccacccggaccagctgcaccccacacgctcctccaccgggtggacccgcacaccgcccgctgctgcgcgcaaccgcgcacctggctcgctcccggagaactcctcgcatcaccccccgaaggctgggcaggcgcctggcaggcggccggtcccggccgcttcacccgctgagaccggaccgaggtgtactcccgtggcacgcaccgtcgcccatgtgatcgtcaacgcactcgaggagctgggagtccagcacgtcttcggtgtcgtcggcgacgccctgaacccgctgaccgaggccatccgcacctcggccaccctgagctgggtgggctgccgccacgaggaggccgccgccttcgccgccggcgcccaggcacagctgtccggcacgctgggcgtgtgcatgggcaccgtgggccccggctccgtacacctcctcaacggcctctacgacgccgccaagacccgcgcacccgtcctggccatctgcggccaggtcccgctcgccgagatcggcagcgactacttccaggaggtcgacaacgacctcctcttccgtgacgtcgccgtccaccgggccaccgtcacctcccccgaccagatgccgcgcatgctggagagcaccgtacgcgccgccgtcacccagggcggggtcgccgtcctgaccgtccccggcgacctcggcgaccgggaactgagcgaggaccggcccgtgcgcttcgcactggaccgcgccgtcacccgccccgacgaccccgccctcacccgggccgccgccctgctgaacgccgcctcccgggtgaccctgctggtcggcgccggcgcccgcgacgcccgcaccgaggtcatgcggaccgccgaacagctcgccgcgcccatggtcctcaccctgaaggccaaggagggcttcgaggaccacaaccccttccaggtcggccagaccggcctgatcggcaaccccgccgccgcccacgcactggacagcggggacaccctcctcatgctcggaacggacttcccctaccgggagtggtacccgcaggacacccggaccgtccagatcgacagccgcgaggaccacctgggccgccgcacccccgtggacatcggcctcgccggcgacgtcggcgccaccctgcgcgccctgctgcccctcctggaccaggcccccgaccgcacccacctggacgacgcccgggagaagttcgtccgctggcaggaaggccagcagcacctggccgaccccgcccacgaacagcacccgggcggccgggcccgcgccgccctggacaacccccaccacatgatccggcccgaggcgctcgccgccgccgtggacacccacgccgccgacgacgccgtcttcacctccgacaccggcatggccaccgtctggctctcccgcctcgtcaccatgcgcggcacccgccgcctgatcggctcctacaacctcggatcgatggccaacgccatgccccaggccatcggcgcccagctgtggtcacccgaccgccagaccgtcgccttctgcggcgacggcggactgagcatgctcctcggcgacctgatgacgatcaagacatacggcctgcccgtcaaactcgtcgtcttcgacaaccaccgcctgggcatggtcaaactggaacaggaacaggcgggcctgcccgagttcgggaccgaactcgacaacccggacttcgccgccgtcgcccgggccctgggcatcgacggcatccgcgtcagcgacccggccgacctggacgacgccgtccgccgcgccttcgcgacacccggacccgtcctcctcgacgtcctgacgaaccccggggaagtggccgtacccggcaggcccaccctcgcacagggctggggcttcgccgtcgccaagatcaaggaaatgctctgagaccccggcggccggccccggcccggccgcccccctcaggccaactcgtcacggatcgcgttgcggtgctcctcgtacaccagccgcgcgtcgtcgttcgccagcgccggggtcgtcaggccgcaggcacacgtcaccaccgtgaggccgtcctgcagcgcctgcccctcgggactccggtaccgcaggtggtgcgcgtggcggggtgggccgacagcgtccgagtcgaggccggcgctggtgtcgtccgaggtgaagaggtgctcactcatggacccagtgtcgtctgccggacccggccgaccggcgcccgcgccgcgcaacgcgggcgcagagtcaccgggccggccgcaggtccgagccccgcaggacggggcctgccgcctgccacgagccgtaagggccgggcccggcacgggctacgcgccgggaggccggtagcggacgtccgcggccccgcgcagggcatcgagcgtctcgtcgacgctcaggagaacggtcgtctcgaacgagccgagcgcgccaccgccgctgatcgccagcgcgaccgaggccatggacacgttgtccggagcctcccagaggttgtagccgtcgtgggtgccgaaggcgtaccagaagccgtggagcttcccgccgacggactcgatgtacgcccgggcggcctgcgcacggtcctcgggccggctgatcagcctcgcccacgtctgcggcgtgtagctgaacctcgacagatagagcggcatcgcgtccctctctcgtttcgtccatggatgcccccaccgggcgcaggaaggaccggccggcccgcggttcccccgaacagccgcgggcgcacggccccggtaccgcacgtgaagagcggctccgcgcgtcggcggcacgaggcgcccgcccgcggcagccgggcagagccgccgcgcctgcccccggcggcgcggccgtcgcccggccctgtagcgtgcaagtgtcaccaggtcagagcaggtcagagcaggtcagggcggggctcatgggaaagcgcaagatccaggacgagtcggaggtgatccggtggttcgaggaggggcgcacgtaccagtggatgatcgaggagtaccggcgcaagtacggcatcgagactgtcgcctcgatgtggggcaacttccggcgccgccggggccttgagcggcgcatcgtacgcgacgacgacctcatcccctggttcgtgaagcaggagcaccgctgggcctacccgctggcgatgctccgggccgaaggccgcagccgcgccggcaaggagccgaccggctcggaccggtcccggctggcctcctggcgccagaccctggaggagaacggcacggtcgtccactacgacccggacaccgaggaaggcttctcctacatcccccgccaggcgggcgacgacgacatcatccgccggccggggaggaagaccacgcagcgccccaacgccgacaaggccccgtgagcgtcccgacgacgagggcgccggccgggctgccgtcgcatccgtggcccgggggcggcggtacgagcgccggcgccgggggttggccgggcgggccccggtaccggcaggggagggggccggcaccgggcgtgcccaggtgccgtacggatccgggcggcagcccgtcgtgccggcgggcctgccgcaggacgccggggggaagggcggccgcggcggggcccgctccgggagcaccccgcccgaggcggcggcttccggtatcacgcgtctgacccgctctcccgcccccaaaccccctttcctgcggctcttttgaggacgcgccaaaaaccggccgcccccgaggggcgggggcgggaacggaacggccccggctcagcggtccccggcaggccggcggcgcagggcgggatcggtcagggcggccggccgccacacgccgtccggctggtacaggttggtgcccggcggcacgatctcgtcgatccggtccagaaccgcgtcgtccggcaccaccgaaacccccttcagcagcgactccagctgctccatcgtccgcggccccacgatcaccgaggtgaccgccgggtgcaccagcgggaaagccaccgccagctccggcagcgtgcagccgaactccgccgccacatccatcagttcaccggccgcctcaagcttcgccgcgttccccggcaccgccggatcgaaccgcgccggcgtcagcgccgcccgcccgcggctcagatcgacctcccgcccggcccggtaccgcccgctgaggaaccccgaggccagcggactccacgtcagcacccccatcccgtaccgcccggcgaccggcagcacgtccctctccaccccgcgcgccaggatcgagtacggcggctgctcggtccggaaccgggccagcccgcgccgctcggacacgtggtgcgcctcggcgatctcctccgccgggaaggtggaacagccgaacgcccggatcttgcccgcccgcaccaggtcacccagcaccccgagggtctcctcgatgtccgtgcgcgggtccggccggtgcacctggtagaggtcgatcacatcggtgcccagccgcgtcaggctgtcctccaccgcccgggtcagccagcgccgggagttgccgccgcggttgcgcccctcgcccatcgggaagtgccccttggtcgcgagcaccacgccctcacgccgcctgccgcgcagcgccttcccgacgatggtctcggactcgccggccgagtacatgtccgcggtgtccacgaagttgatgccggcgtccagggccgcgtggacgatccgtacgcagtcctcgtggtcggggttccccaccgccccgaacatcatcgtgcccaggcactgcacactcacttcgagtccggttccgcccaggaacctgtatcgcatcgtcataccggcggaccctacgagttggagcgcactccagcgcaaccctcggcgcccttaccgcaacccgcccgccgtcttctgcacggtccggctctcctgggcgtacggtcgcggacaccggcgcctaggccgtgtccgcaaagtcccgcctgccccgcggcgtctggcaccgcacctagggcctctccttcggatcctgccgggtgggttcgcggacggagggggtccccgcgccggctgcggatgtgatcggccgccgggctttcggggtgaaggcgaaggagccgaaggtgcccttcgccgcgaagaacagcccgccgtcatctgcggcggccagcgcgtccaggcgccgacccggcagggaacacccctccacggtccggccgtcgggccccaaccgccggatgccgccgtttgcgtcccccaccaggaggccgtcggcgtacggcagcgggtcgaccaccatccgccgatccgcctcgaccgaccacggcgacgtcccgtcggcgggatccaccgcgaggaaccctctgcctgaccgcagcatccagaccgacccgtggacgtatccgaccgccccgaacggatcgtaggatccgagccgggcgggcttgtccgcgccggccccgaagctcaccagggacgaggcctcgcagaccgccaccacccgctccgcatccacggggacgaagaccttcgcgtcgggtcccgcgagcgggtccggcagccgccaccgcgccaggtcgctcccgtcggccggatcgagaagaaccgcctcgtacccgctgccggtcagcaccccgccggcccacgcaagggtccgtacggacgccaccggcgacggtgtcgtccaccggacgctcccgtcggcgaggtccaggccactcatcggggtgtagccgcgccagccgcccgtcaccacggtgtccgagtggaccgcgaggtttcccgtccacctcggtgtcgggacgctccacatcgacgcacccgtccgcagatcgatgcaggacagcaggttcggtgcttgcggcagcaccagcacccggtctccggcgaggacgatcccgcggggccaggtaccgagcgggacgtcccagcgcaccgcgccgtccgcgcgctccaggcagacgagccgggtgtgccgctcgtgcaggacgacacagtcaggccccacgacgaaaacggaagcgccgccccgctggtgcagttcgcgctcccagagcactgtggcggtcatcgggccatcccaccacaggcgccacgccccgacgaaggtgcccctgggcgggacggccgcctgggcggtccacgtgcgccggctcgcgcggacggccccgtacggacggcacaggacggccgtatcgttttccggctctggcggcggggatctcttcgcgcagtggctttcaccgccggcgcctccccgctgaactgggcacatgcatcccacacaggccacgacggacgccggaccccgcgacgaggagggaagcggcgagtgcgagcgggtccggcaggtcctgcgccgcgccgggttcgacacctcgacgcccgcgcaggacggcctgcgggtgtgggcggacgccgagggggtcatggtggggtgggccgcccgtgaggtgctgcggccgaccgtccaggtccacggccacgaggaggacctcggccggctcacctccctggcggggctgcaccaggcgctccgcacggccctcgccgtgatcctggccgaggcgggcctggacgccgcgccgcacggggagcacctcgtcgtggtccgcccgccggggcgcgcgcgggccggcggagccgcgggggcgccgggctgatccgtcaggggccggtgagcgtgtgccggggcaggaccccgtacgcctgccggtaggcggcggcgaaacgcccctggtggtggaagccccaccggtgggcgacagccgtgaccgtgtcccgcgcgggatccgccgcgaccaggtcgtcgtgcgcctgtgccaggcggacgcggcgcaggtaccccatgggggtcgtgccgaggtggcgccggaaggcgtactggagggcccgcggggtgacgccggcggcggcggccgtgtcggccaggccgatctcggccgcggggtgcgactcgatgaacgcgatggcgcggcggacggtctccgacgtcgcgtcgcgggtgtccgcgaggacgggctcggggcgggcatcggtggggaaggccgccaggacggtcgcggcgagcagcctggcggcggcgtcgaccaccagcggcgcaccgtccgcgggcagggccaggaggctctccccgacgtagtcggcggtccgcttccactggtcggccatggcaggggagacgggggtgaagcgggtgaagcgcagcgggcggccctgcccggccgggcggcccgcggcttcctgcaccagcgtgagcggcaccgtcacggcccgcagctcggcggcgtacacccggcccgcgtaggggagatggggctgcgagatcgccaggacgtcaccgggcgcggcccgggtgacgtcgtccttgcactcccggaccatgcggccgccgacgacgtgcgtgacggccacggcgcccagcgggccggtggcgtaggagtactccgtcggcagcgccagcgtgctgagcgccagcgggccggcgctgatacgggagtactggaacgcactgccgggcgcgggcgcggccatgcgcaggctcgtcccgtacgacgtcttcaaccagtcccgggcgacgtcgacttcggtggtccggaagctctgcccgcccggcggtaccgcctgcggctgctgtggcatggcagcggacgtcctctcgcgcggcgggcgcggcacggaggagcagcgcggccccagagtacgtcggcggacgaacacggggcgcgccttcgcgtcatgagggacgcggcacgtgacccgggacgcggggcccgcgtcccgggtggcacgagaagcccggcgacgggcaggtcaccccccgggagccggagccggagccggagccggagccggagccggggccggggccggagccggggcaggggccggcgcgggcgccggtgccggagcgggcgccggggcaggtgcaggtgccggggcgggcgcaggtgccgggttgggggccgggttgggggccgggttgggcttggccggctcgggcttgtgctcgcagtagaccttgcccttgtagaacttgcagcccggcatgttcttcacgtccttgggccggttgttcttcttgccctggtggtttttcctcttgtgcttgttgtgccagtcacccctgtgatggtcaccgtgaccaccgcggtcacccttggcgagatcggtatgactcacggtcatcgaggcggcctcgctgaccgacgagggcgccgtcgccgcgaaggcactgccgggcaccagcacaccggcaccgacgaacgcggccgacaccgcgaccatggcgaaacgctgcttacgagtcgaacgggacatgagaagtcctcctccggagggaatcggtgaagcggaacccctccagtaggccctccccgccaccggcgccacacgtccccatatcccgtgacttgacagaccgcacgcggcggcgccccgccccgggaccccccgggggcggggcgccgccccgtgcgcaggcgttctacagcagggcgaccgaactcgcccggtcgttcatcgcgtccccgacgtaggaggtcgactgctggtactcctggtggataccggaggtgtcaggggcgtcccacagctccagccagcaggacagggtggtcagcgagctgacggagttgttccagatgccgtcgaggttgagctgggcgtcgcggccgttgccgctctggcagccgctgccgccggttaagaccagggccgagccgccgtagttggagtccgcgtagatgacgccgagctgcacggcctgcgcccccgcggggcccggagaggccttgagacgctcggccagcttccggtcgatgtgcttcgccgacagcggcgcgtccgcgatacgcccctgggtggaggcggcgaggcctcccggaaggtgccgtagcactgcttgctgcctgaatcgacgtcgaccacacagttcgccgccgcaggcgcgggcgcgggcgcggcgttcgcggtggtggcggcggtagccagggcgagggcggtggtggctgcggcgatggcgatacgtgacgtacgagtagacacgggtcgctcctgtccggtggttgtcatgccgacacggtggatgctcgcgtccccgtccggcatggaccaggggcacattcggccagagtcgttgtatgcggcacgtgttgttgcgggtcctgcggcgacgcgccgtgccgtgcgcggttcttgacctgccccgtgacacgccgggcaggccaccggcgcccctcgggaggacaccgggaaatgcggcacgaactgttcgcgggccgccgcgcacgggccgccgcgcacggctgtccccgggagcgccgtaccggccggcccgccaccgggcggtccaagcccccgtggccggatcggcgttctgccggggagggtccgggctgtgttcagctacgtgccggcacctgccgggccccgccgccgcccttcggcgccgccgcccgtacgcacccgtacgtaccggacgcacccgaggaaccaggagagagccatgcctcgcatcacccggtcggcggcggtgaccgccgccgccgtcgccttcgccgccgctctgaccggaaccgccgatgccaccggtgccaccggtgcggtcgcggacgcggtccggaccgccccccggcccgtgtactgggacgcaccggcacagggcgtgacggccgccgcgccgcagcgattgatgaaccagcccgtgcggatcaccaacgacttcgccacacgcccgaccacccagtgtctggacgtggacgcgaacggcggcggcaacggcacggtcgtccaggtctggcagtgcaacggcaccacccagcagcgctggtacctctggaacaacggcgcgctggagagctaccgcttccccggcaagtgcctggacgccgacctcaacggcggcggccgcaacggcaccaaggtgcagatctgggactgcaacaacaccgcgcagcagagctggtcccacccgtcgggcgaccgcgcgatctacaacgcccgcttctactccggcgggaacaccgtcatggaccgcgacgcgaacatcccgggcaacggagcccgcgtccagctgtggcagaagaacttccagtcgcagcagtggtgggacgtctggaccgactgacccccgtgcccggaggatgcccgccgcaagatccgggtgcaccctgagggagcagggctacggagtggggcagcaccatgacaggggtatcgaccgggccggcgaccggcccgctgttctcccaccgcgaccgggcggtcatcgcggcggcgtcgctctcgatgctgctggtgcagatggactggttcgccctgaacctgatgctgcccgtgatcgcgaaggagttccgtaccccgacgaccgatctgcagtggctcgtcagcggctacatgctgtcgctgggagccctcatgatcgtcggcggcaggctcgccgacgtccgcggccgccggaccgtcatcgtctggggcctgaccgggttcgcactgctctcggtggtctgcgccgccgcgcggaacgtgccctggctcgtggccggccgggtcgtccagggcgccacggccgccctggtcttcccggtggccgtggccgtcgtgaccgcgtacttccaggaccggcggcaggcgagagccgtgggcaccgtcctcgccttcagcgccgtcggcacggcactcggcccgttcgtgggcggcgccttcgccgagcacgtgagctggcgcgcggtgttcctgctgaacgtgccggtctgcgcgaccgccgtcctcctcatcctcagattcgtgaccgacacccgcgacgaacacgcctcgcaccggatggacctgcccggagccgtcaccctggcgggcggcctgaccgcggtgatgctcgccgtggaccagggcagccggtggggatgggcctcgcccgccaccctgctcgtcctcatcggggcggtcctgctgctcgtcgccttcgtactgatcgagaccaggaccgccgaaccgctcctggacctgtcgctgctgcacaacaggcccttcgtgacgatcacgctcgccgggtcggtgtccaacatcgtctactgcctggtggccgtgctgtgcgcgctgtacctgcagcaggccaggggactgtccccgctggacgcgggactggtcttcctcgccctctccgtgggcgccggctcggccagctacttctccgggcacctcgcgcagcggtggcggccggcggcgctgatggcggcgggcctgctgctcagcggcgccgccctgctggtcctcacctggagcgggcccctcgccctctacaccgccgtgttcgccgtggtcggggtcgggctgggcctcggctgggccctgaccaacgccgccacccagtcctacgtggccccgggccgcctcgccgccgcgtccgggctggtcctcacctccctggtgctcctgggcgcggtcgccgtcagcgtggccgcgacggtcctggaggccctgagcgggtccgcgcaggcggcggcctcggacgcggacgccatcgcatgggtgctgcgcgcggcagcggtactcgccgtggccggggcggcgctcctcgttccgctcctgcgcgccggcggcgggcacgacacctgaggcgcaccgcccgccgcccccgcacgaacgggcggcggcgccaccatccagccgcagccgccgcattcggcccggcccggaccggcccgcccggaccggcaccggctgcgctacgccggcccggcccgggcaggtgctcagaagtcccagctctggctccgcgccccgttgcagctccaactcaccaggagctggccgttctcgggccgcccggccaggatgtcgagacacttcccgttcacccggttacggatctcgctgccgatgcggtaccacttctggtggagagcgccgttgcagtcccacagggacaccgagccctgttcacccagatgcggaccgtagatctccaggcacttcccgttcatgctggaccggatctgctcgccgtcccagtaccactgctggttggtaccgccgtggcagtcccacgtcacggtggaggcaccgttctcctggtggaacatgaagacgtcggcgcacctcccgttcaggttggacttgagcagcggcgccacggcatacgccggcgagcccgtgaacgcagcgccggccagcagccccgtgaccgcccccagcagcatcagtcgtcgcacagccctcatgatttccccttcccatcgccgttgcgcggttgcgctggccccttgtctagcccccggccgatgtccggcgccggaacagggattccggacatcaaaagctggacaaacaccacccatcacggccgcggaaagccgcaggaaggaaggcaatgccacgccccgaacgcccgctcgacccggactccggtccgctcacacggttcgcggccgacctccgccgactgcgcgaggcagccggccggccgccctaccgggcactggcgaaaagggcgcactactcgtccaccaccctctcggacgccgccggcggacacacgttcccgagcctcgccgtcacactcgcgtacgtcgaggcatgccagggcgaccgccgcacctgggaaacccgatggcacacggccgccgccgagatcgccgccaccacggccccacaggccggcgagcccggcccctccggccggcggaccgccccctacgccggactggccgcattccaaccggaagacaccgaccgcttcttcgggcgcgagcagctgaccggcgagctgctcgccaaggtccgcgaccaccgcttcctgaccgtcttcggcccgtccggatcgggaaagtcctcgctgctacgggccggactcgtcgcccgcacccgcacagcgggccggcccgtgctcctgttcaccccgggcccccaccccgtacaggaacacgcgatccacctcgccgcggcaacgggagaagcccccggcccgctgctgggcgaactgcgcgacgaccccatggcactgcacctgcggatccggaaagcgatgatcggccacccaccggacgccgacacgctgatcgtggtcgaccagttcgaggagaccttcaccctctgcggcgaccaggacgaacgcgacgccttcatcaccatgctgatcaccgccgccacggcgccgaccagccgcacccgcgtagtactcggcgtacgcgccgacttctacggccactgcctccaacacccccgcctcctcgaagcgatgcgcgacgcacagctcgcggtcggaccgatgagcagccaggaactgcgcgaggccgtcgtccggccggccctgctcgccgactgcaccgtggccggcccgctgctcgcagccgtggtcgcggacgccaccggccagcccggcgcgctgcccctgatctcccacgccatggtcgaaacctggcaccggcgcagcggcagccgcctcaccctggagggatacctggccgcgggcggaatccggcacgcgctcgcccacaccgcggaggcggcctacggggccctgtcaccggcacagcaggacctcgccaagtccctgttcctgcggctcaccgcactcggcgacggcaccgaggacacccggcgccgcatcaccgcgaacgaactcgacccgcaccccgacaccgcccacgtactcgaatccctcgcccgccaacggctcgtgaccctctccgacggatgcgtcgagatcacccacgaagcgatcatccgctgctggccccgactgcgcggctggctcaccgaagaccgcgaccggctcctcctgcaccgccggctcaccgacgcgagcgccgactgggaagcacaggaccacgacccgcacgccctgtaccggggcgcccgcctggccgcggcactggacctggccgccgccggcgacagccgcctcaccgccctcgaacgccgcttcctcgacgccggccgcgaagcccaggccggcgagaccgcggccgtccgacggcgcaccgtccgcctgcgccagctggtcaccctgctcaccgtgctggtggccgtcgcggcgaccgcaggcgcactggccgtcggctcacgcgactcggccatccgccagcgcaacgtcgccgtcgcgcgcaaggccgccgcggacgcggccgagatgcgcccgcacgacccctcgctcgccgcgcagctgaacctggccgcctaccggctggcaggcacccgtgacgtccgcgaccagctcctgagcaccttcgcgaccccgtacaccggccggctcaccggccacacctccgacgtggtatcgctctccgccgccccggacagcaccctcctggccaccgcgagctgggacggcacggcccggctgtgggacatcgagaacgcccgccgcccgctccagctggccgtcgtgaaccagcacgaccgcctgctgtcggtcgccttcggcgaagacggccgcatcctggccacagccggcgaacacgccgtgcggctgtgggacgtgaccgaccggcgcgcgcccgccgaactgggcaccctgcccgaccagcacaccgccccgacctgggtggcgtaccggcccgccggcggtgtcctggccaccggccacaccgacggcacggcgcgcctgtggaacgtggacgacccccgccgcccgcggctgctggccaccctgcccgggcacaccgccgcggtcacctcggtgacgttcagccccgacagccgcacgctggcgaccaccggcgacaccaccacccggctgtggaacgccggcgaccccgcgcaccccctcctcctcgacaccctgcgcggccacaccgacaccgtgacctcggccgcgttcagccccgacggcaggaccctggcaaccggcagctgggaccgcaccgcacgcctgtggcccatcgccggcggcgaccggacgcgacccgccgccgtcctgtccggccatcccgcgatcgtctggtcggtcgccttcagcccggacggcaccaccctggtcaccatcggcggatccacccacttctgggacgtcaccaccccggccggcccgcgccgcaccagcaccctccagggcggcttctaccaggccgcgttcaccccggacggccgcgtactcgccaactccgaccggctcctggacctgcgggacctctccctcgccacccacgacgacgtcgtcacctccctcgcgttcgcccccggcggccgcctcctggccagcgccagctgggacggcaccgcacgcctgtggcaggtcaccggcggccgcgccctgtggccgctgtcggcgctgcacggacacacccggttcgtccgctgcgtgacgttcagcccggacggccgcgtcctggtcaccgcgagcgaggacggcaccgcccgcgtctggaacgtcaccgacccccgaaagccccgcctgacatcggtcatcacccccgacggcggcgaggtcgccggcaccgccttcgccccggacggccacctcctggccgtctgggaccagcagacggccggcctgtgggacctcaccgatcccgccgccccccggccactgagccggatcaccgacagcggaccccacgtcaccacggcctccttccggcccgacggccgcacgctggtcacgagcaccggcgagtccggctccctgaggttctgggacatcacccgaccgcgcaccccccgcgaactcccgtccccgttccgggccgaccccctcaccggcggcgtgttcagccccgacaaccggcaactggccgccttccaccgcaccgacaagaccgtctggctgatcgacgtccacgacatccaccacccggcgaagaccgcacaactgaccgtgcccggctcctggctctacaccctggccttcgccgcggacggccgccggctggcggccggcgccgcggacagcaaagccctcctgtgggacctgaacggcccgcccgcccccgcggtcctcaccggccacaccaaccccgtaccggccgtggcgttcacgcccgacggcaacaccctggccaccggcggcaacgacttcaccatccggctgcgggacaccgccctggaccaggtcaccgcccgcatctgcgacagcgtccaccccccgatcaccccggcccagtgggcccagtacttcccggcactcgacttcgccccgccctgccccgccccggccgcccgcacacgccccgcactgagatgagaccgcggcacccggaccgcggccgtccggccccgcctcacccacggcggccccgcagggctgccgtgggtgcgaaccgggcatgccttctgccggagccgcgacgcacgagggggcagctgatgacggacgacagcgaacgcgggcacggacggacggggaagggcgccgccgccgtgctgcgaacggcctcggtggctgccggcgtggcggcggccgcgctcctggtcgtcgacttccggctgaccggtccggccggccggcaggtcctcgcggtggccctgacggccgccttcgtgagcacatgcgccggcgcggcctcgggcctgacggaccgtctgatgcggccggccgtgcgccgggcccgaaggctcctcgcgcaggagcccgacccctggggaccggaccgggagttcttcgccccggtgcggcgcctgatgctcctcggggcgctgcagaccctggccggcgtgctggtcctgctcaccgtgtatccgctcgccctctgggcgggcgtacggatctgcggcgccgcgggcctgccggcgcgcctgaccggaacatggccggtcttcgtctcagggctgctggtggcggccgtcgccaccacggcctcgaccttcctcgccctgttccgccgccgcaccggccgcgcggccgcacgctccctggccgccgtcctgctcaacgccgccgcactcgcgctcgcctcgctcgtgctggacggcatccgcctcgaccccgcgccggggtggcgccaggcactggccctgtgcgccgcggcagccctgttcatgctgccgcgcatcaccctgtccctgcccgtaccgggaatcgcctcgatcgtcctcgtcgcctaccactgcctgctgctgtggctgatctgcgcggccttcgcctgcgcggacccccggcttcacgccgacggcttctggccgctggcgggggccgccgccctcatgtgggcggccgagtggcccgcgcgcctggccgccgggcgcgcgcggggagccgccgcccggccggctcccgccctgcccgatccgttcccgccggatcacgggttcccctccggcccgctgtactgagaccgcaccgggggcccggcgggtgcggcgggtgcggcgggtgcggcgggacaacggtgcgggggagaggcggagaggggggaacagacgcctccctctggccctgccgcccgcgcgccgtatccgtccaggcgcgccgtttcggtagctttctcccggttccggcccgcgatcccgcccgcaggacgacaggcggcggcaggacgacgcgggcgggacgaccatcaccggggcgacagaaggcggacgcgatgacggtgcacgtgcgcaggaacgtgtggacacttccggacggcgacctgacgctcgcacactatgccgcggccgtcgccgagatgaagagccgcgacccgcaggaccccacgagctggttctaccaggcagccatgcacaagacgacggtgacaccgccgaagccgctgtggaacggctgccagcacgggtcctggttcttcctcccgtggcaccgcatgtacctctacttcttcgagcggatcgtgcgcgcgaccgtcgtggacctgggcggcccggacgactgggccctgcccttctggtcctacgacaccggcggcacacaagcccggatccccgccgccttccgagacccgcaaggcggcaccaaccccctcttcgcccagcggggcaacaacgtcaacctgggccaggccctgcccttccagatcacctccccggcatcggcgctggcacgccccaagttcgtcggagaggcggaattcggcggcggcatcaccccggacggtgacgccatctggaacagacacggacagatcgaactcaccccgcacggcgccgtgcacaaccacctcggcggcctgatgaagaatccccgcaccgccgcacaggaccccgtcttctggcttcaccacgccaacatcgaccgcctctggtccgtatgggcgagccgccccgggcacagcgacccgaccgccgacccgcgctggacggaccaggaataccggttcttcgacgccgacgggaccgagcggaccctgaccccggccggcgtcgaggacatcgagaaccagctcgggtacacctacgaaccgcacccggcgatcaccaccccgaccccgaccccgaccccgcccccggtgcccgagatggcggcgggcaatcccggcgcctccggaccggcccggcccgagcggagggaactgatcggagcgtcccggcatcccgtccgcctcgtcggccgcgccgcgagtgtcgccgtacccatcgacgaacgcacggtgcgctcgctcggcacgggcctcggcgccatggccgccgaagcccggggacgggtctatctcagcgtcgaggacatcgagggcgacgagagccccgacaccgtctacggcatctacgtcaacctgcccgacggagcccccgacgaactggcggagagccaccgggtcggcaacctgccgttcttcggcatcgagctggcacaggatccacgaggcgacgaacacccgcacggcctgcgggtgaccgtggagatcaccccgctggtgcgcagactcgaagcggagaacgcctgggacgaccgcgaggtgcgcgtgaccttccttccgctcggcttcacggagccggtcgaccaggacgaccccccggtccagatcggacgcgtcagcctcggctacacctgatgacacaggtgaacgcccggcgggtgcgctccttgcggacgatgcgcgtgcgccggctgctgcggccgcgggtctgcctcggcttcgagctggcggccctcgccgcctggatcaccctggccgtgctgaccgcggccgccgggacccacggcgcgcacggggctccccacacccacgcagcggccggcccgaaggcggccgcccccatggacctggcgatgtggacgctgatgagcgtcgcgatgatgctgccctcggcggtccccgaactcgaccacgtgggcaccaacagcctgcgccgccgacggcagcgcgcgatggcgacgttcgccgccgcctacctggccgtctggatcggatacggcgccctgctgctgcacctggcaccgctgtggtcgccgctgcccgggaaggccgtactcgcctcggcgctggcgctggcggccgtatggcagctgaccgtccacaaacgccgtgccctgcgggactgccaccgctcctccccactgcccctgagcggctggcccgcggtggccggagccacccgctacggactgcgccacggcggagcctgcttgcgttcgtgctgggcgctgatgctcgtgatggccgtggcgggaggggccgccggggggatcgggatgctcggctggaccgtgctgctcaccgggatcgtcacgaccgagaaactcgcccgcagaccgcgccgccccacgcacgtcgcggccgcggtcctggccgccgccgcggtgacggccgccctcaccgccgggctcgcctgaacgccgcccgccgtggcgcgagtggggggagtggggcggtcggggcggagtccggccgccgcgctcacgggtgccgcgggccgggccccttgtacggggccggccggtgtgcggtgcgtcaggcgttgacgcaggtgttgccgaaggccgggttgagcaggccgatgacgttgacgctgttcccgcacacgttgaccgggatgtggacggggacctgggccaggttgccggacaggacgccgggggaacccacagcggcaccgtgggcgccggcgtcggcggaggccaggcccgcggcgcccatgacgatggtggccgcggtggcggcgatggcgaagctcttctgcactgcggacatgatgcgctcctcgaaacatgcgatgggggtggggttccgcgggggcggaacacgggcaccgtccccgggcccaggtgcacgcttcgacccggggaccatgccgactcccgtgcaacgcacgcccccggccccaggacacgactcttcgcccggtcgggtgcatcgcacgcacaccggcaggcacgcaacggcgggagccgacccgatgcggggacaccggtcggcgcccgaagccttcgccgccgcccgcgatcgccgtcagggtgcactttgccgccgcccgtgcgtcccgccgggacgggagccggtcgccccctagcgtgggtccgcaacgatccgggcgtaccgccgccgggatcccggccgttcggaggcgctaccccaccatgaccgtcgaaatctccgacctcaccggggactacgtcctcgaccccgcccatacccggatcgggttcgtcgcccgccacgccatggtgaccaaggtccgcggcgcgttccaccagttcgaaggcaccgcccacctcgacggcgccgacccggcccggtccaccgcccaggtggtgatcaaggccgagagcatcgacaccggcgtcgaacagcgcgaccagcacctgcgcaccaacgacttcctcgacgcccccaacttccccgacctcaccttccgcagcacctcggtcgaaccccgctccgacaccgagtaccgcgtcaccggcgacctgaccatcaaggacaccacccgcccggtcaccgtcgacctcgagtacaccggcaacgccgtcgacccgttcggcaacctgcgggtcggcctggaaggcgcggtgaccatctcccgcaaagacttcggcgtgacctggaacgcggccctggaaggcggcggcgtgctggtcggcgacaaggtcgtcctggagttcgacatctccgcgatcaagcagggctgaccgcgccgtccgggccgcccccctctccccgcacccccctccgcaccccctccccgcaccccctccccgcgccccgtacgccagacgccgcgcgggtgcggggtgcgggccggggcctggatggcgggccggcgcgagggctggcagcctgagaggagaagccgtagcggcgggccgtgccacgtgccgccacgtacgcgacgtggcaccttcaccgccggcaacccctgttcgtgttcgcgggaggtggacctccttgagcagacacgcctcgttcctcaccaccgcacggagcctggctgcggccggagtcctgtcggccgcactgataccggtgtcggccctgccggcggcagccgccacgtgcgacgccgcggccgctgcccgggccccggtcagcagcaacgacagcgccgcacggaacgcactgatatgcctcatcaacaaccagcgcacgcagagagggctgcccgccctcaccacgaaccaggcactgaccaccgcggcgcagcagcactccgccgccgccgtgcagcagaagtggtggggaccgggcagggattcgcaccgcaacccgcagaccggttcgacaccgcagacccggatcaaagccgcgggctactgccccaaccccaggtcatgggccgtcgccgagatcacctacaccggctggggcggctccgggaccccgaacgccgcggtcaactggtggatgaacgtcagcacatggggccaccgccagatcatcctcgacccgtcgatgcgagagatcggcgcctgggcccagccgggttcggccgacccggccggagccggcgcgagccaggccggaacctacgtcgtgaccttcggccgctgccagcagtgaaccggcagcagtgaaccggtgcgctccgcaaccccgttcgcacggcagccgcggccgccgcccacccgtcccggcctgccgtgctacgcccgcttcgcggcgcacagggccgtgtccaccgcgctctcgacgcgcctcgtggccgccacgtcggcggggacggcggtcaccgtgacgcttgccgccgcgcggccgtcgtcggtgaccccgccgcgggtctcgtaccccgggatgtcgccgccgtggccccagtagaggccgccgcacgacagaggcctgctcatgatccccagtccgtatccggcgccggtgtccccgagggggacggtggcgcgcatctccgcgagctgcgcgtcctccagcaggtcaccggccaggagcgcggtgaagaaccggttgaggtcggagccggtggagatcatctgtcccgccgcccagctcgcggacgggtcgatgcccgtgacgtcgtgccacggcgcaccggccgattccctgtggtagccccggggatggcgttcccggagcgttgtgtcaccggcggccgggaagtaggtgtggcgcagtccggcggcccggaccacacgcctgtcgatctcctcggcgagcggccggccggtgaccttctggacgatcaggccggccagtacgtagttcgtgttgctgtaggcccagcccttcccgggggcgaagccggccttcttgcgcagggcgatgtccaggaggtcgcggggttccaggtaccggcgttccaggagggcgtcgccgacctcctcctcgtagtcgggaatcccgctggtgtgctggagcagctcacggacggtgatgccgcgcccgtcgatcccctccccgcggacgagacccggcagataggtgtcgacatcggtgtcgaggccgaccttcccctcggccaccagctgcaggacgaccaccgcggtgaaggtcttggtggtgctgcccacccgcacctgcccgtcctgcggcaccttcgcccccgtggccaggtcgcccacccccgcggtgtaggtacgggtgcggcccttgccgtcccggacgctcgccagcgcggcgggcaggccgtcggaacgcaccagcgcgtcgaggtgccgctggaccgcgtccggccgggcggaggatgccgcgggcggtgccagggcacccagcgtcatcgcgcagacggccaccgccgtcgccgcggccgtggcggttctgcgccggccgcccggccgccgacaggaagaacgaagcgtgtgccatgtccgggtgtgcacgggccaactcctgtgaagcatcgggattccagcggtttccgctcccagcctctccgggggtgcccgtccccggcgatcatgccacccggtccgtcccgggtggggacaccccccgggaccgggggaccaggggagccgtgccggggccggggccggcggatgcggcccggcgccaggcgtgcgggagcggtacgggtgacggggacgcccggccggggatccgcgacacgaccccgggggcgcggacctccggacccccggcccttccccgccgaacctggcacgtccgcgcggggtgcgggcgcgagcggccggcgtgcgccgcgggctcaggcgacgacgcgttcgacggtggagagcacccgcaccagcgccggtgacgcgggggccgacgcgaaaccgaagcgcacgggcgggacgaccggagccagcgcgccgagaccggtcccgccgaaggaggcccgggcggccacgatcggccacaggccgcccgccgcgtaccactggcggcagccgggccgcgagctgccccgggtccgcacaccggccatcaggcgtgcgggaacgtccgtcacggccgcccacagcggccgtcgggcgagcgaccgggggacggcccgcagcgccaggccgagaggtccctgacgcccgacccggaagcacagctccaggggtcccgccgcgacctcccacgcgctgccgcggatccgcacgcccaccgggcccgtccggacctcgtcgaagtggtagacaccggcgatgtactccgccgtccggggggtgggcgcgagcagcgtgcgccacccgtcggcacgctccagcatcacgtcactgaacggcccgaagggcgaccgcggccagtggcccacgaccacgcgcgtgccggatcccgtgccgacggcggcgatccagccgtcgaacaccagccgttcgcatcccacgccccacccgtaccccgccagaggctgcgcataccccggaccgggcggcggccgtcaccgcccgcacgtccgagcggtggtgcacagggggttcgaggaaacggcgcgagcgcctgttacagagctctgaacccattcggcgccggcctggggcatggcgtgaatgaacttcttatctggccgaaatccccttgttccggcgctgacggggccgtccccgcctcccgcgccctccgcgtcaacagagccttgacgcttgcctcttacaagggagagttacggacatgtccgcattgcgcaacgcgcgtcgtgagttgtggcggttgatggcggccgcgggccagagtgtcgctccccggcaggacgccgggaaacgtacggggcccgcccggatcgcgaacgcggccggaccggccgactgctgaaggagccatccgcatgtccgcttccctcgccacccgccgcgccgtcaccacggtcctggccgccggcgcgctgatcggggcggccgccctgccggccgccgcccacgacgacgaccggcacggccaccggggttcgcactcctcggtcgtcatcagcgacgtccagtacggcaccggcggccgggaccgctccgaccgtgcgctgaaccgtgaatgggtcgaggtggagaacaccggccgccacgccgtcaacctgcgcggcttcaccctcaccgaccggcagggcaaccgctaccgcttctccgacttccgcctggacggccgctccagcgtgagggtccacaccggccagggccgcgacacccgccacgacgtgtaccaggaccgccgccaccagatctgggacgagcgcgacaccgccaccctccgcgacaaccgcggcaacgtcgtcgacaccgagacctggggccgccgcggctcccgctgacccggcccggcagccacaccatcggggaccgtgaactgccggccaccagcagcaaccgcgtgccgcggccgaccgccgcggcacgcgacacccccgccgtggaagcagcggcccatccgacgcaggcaggtcctttcgtggagttctggcagtacgacccgtccgaggtcacggtccctcagctggacctcgacccctaccgcttccccggcgccgacaccgcaccgcccgtctcccgcggcgccctgccgcaccaccgcccgggcgacacggaccggtacccgcaccacctcggcgaagagcgtccgacggcacacgcacccgcgcccgcgcccgcgtccgacccgcgcctcgcccggtccctgacccccgtggaccggcgcaggctggacctgcaagcggcgctgaccaccatcggcgttcccccacggcccggcgatctggaatccatcaacatcctcgcgtcactcgacgacacgacccacgccaccctcgtacggtggatcaccaccagccgctgagcccgccccccgcccccaccgcacacccccaccgcacccccccccgagaccctgtggagatcacggacccgggcggaccgttagggtctgccggtatgaccgccgtccgttccgcgcgttccgcccgccgcgcgcgttgcgctgaacggatgcagtcgccgagcagcagagcatccgtagggatcacagcggacccctcccgcgttgaaccgtcgaacggtgcgctccgcacaggcacaccgcgccgcccacgggacgaggaggatccgatgcacgccgccgaggagaaccggcaggagctggacccggccagcgtcctgaacgcgaagaggacgctgctccagctgctcggccgggcggggttctccgccgacgacgcgcagggcctgatcgccctggtcgaggcgggcgccctggccggcgcctgccaggaggccggcgcgctcggggcttccgtaccgggggacaagggcgagccgtacgagtcgggctggctggacggtgcccgtgccgtcaccgacgcgctcgcagggatcgccgaacgggccctgcgccagagcgtcgaccccgacggaccggccgccggcccggacgtccggccgccggtcgggcggatggaggtggagcgggcgaaggtggccgtcacccccctctacctcgccttcaccgcggcctccgacctcgaccccgaggtcaccgaggaggtactcgccgccgtcctcgccacgatgaccccctggcagcgggccgggtacgccggccggctggcggccttcgccgcggcgaaccgggcccgtctggagcggctgtacgtcgcgtacgggcccggcagcgccaccgccatccacagccgctactccctcctgcactccgccaccagcatcgccgtgctggaacggctcgccacggcggcgaccgcgctgcaggaggagtgggacgccgccgaactgccaccggcctggctggacggcccgatgacggcctgggacgcggcggcctgaccccgcagcaccggcccggcagggcggcgtcaccggaagcccccgcctccggtgcctcgccctgtccccggcccggtcccgcccctggcgcacccctgcccggcgctcacgtcaccaggcgcagcgaggttcccgcgatacccagccgtacgctctggccccaggtcagctccagggcgtcggcctccatcccgtcaccgaagaccacgatccggtccgactccacggtcagccgcagcccctgtccgcgccccagctcaccggtgaccctcgacgtgccggtcgcgggcgagggccaggcctcgcgcacgaaccacaggagccgctcctcgcacggtgcgggcagccccgtggcgctgccgcgctccagccacagggagcgcagccagccggtggcgcccgtgccggtgcccaccagcaccccggaggacgcctgggcctcgcccgggccctcctcgccgtcggggcccaggcggtagcgggccgtctggtggccgggcgggcccaggtagatctcgttcagcgcgagcaggcgctgggcgtcgtcggcgacggcctcgaccatggtcagctcctccgcccgccccccggcggcggccgcggcacgcagcagggcggccgtgtcggcgcagcggtgacggaccaggaccccggggttgcgccccgggtcggtgtcgatgcccaccaccggctgcccggcgaggtacttcgcggtgttggcgaccaggccgtcctggccgaccacgaccaccacgtcctccggggcgaacaggaagcggtccaggtccgcccgctccacccgacagctgcgccaggtcagcggcaccgccgccgccacctcccgcagcgcctgccgcgtgcggtcgtggcggcggaccacctcgtcgatggagcggccccggctggagaggaagaacgccgcctgcccgtgcgtcccgtgccgggcgagcagttcctcgtactcggtcctgcggtgcaccaggaccgcccgcggggccaggctcacgcgcccgccccgccgtccggacgcccgagccgggtgaggagcccggtcaggacatcgggggagagcgtgatgctctcgatccgcggcaggttctccgccagccgggtcgccgccagggcgtgcagcgtgcccgggccggcttcgccgtgcacccgcagccaggcggcctgggcctcggcgcgcgccgcgcccgtctcgcgcgccgcctcggcgtccgcgcgggccagggtgaccttgcgggccgcctcggcctcgctccgcacgccgtccgccgcggcctgctcctcggcctcacggcgggtgttgatgccgcgctgctcgaccagctgctcctcgcgccgggccagttcgatctggctggccagctcgttctcggcgatggcgcgctcgcgctcgacggcgacggcccggcgttcgtaggtggcccggtccgcctcctgctggatctgctcgcgggccggggtgcgcagggcgcgctccacctcggcctcggggcggatcgcgacgacccgtacggccaccacgtcgatgccggtgtccgggagcctgggctcggcggcgagaccgtcggcgacccgctgccgtacggaggcgacgccgtccaccagggcggcggccagcggggtgcgggccagtacgtccagcgtgtgctgctgcgcggtctcggtgaggagggtggcgatctgctccaggggcgctccgcgccagctcccggtgtccgggtcgacggagaagtcgagccggtcggccgcccgggccgggtcgctgatccggtaggtgaccgtggcctgcacggtgacgtcctggaagtcggcggtacgggcgtggaacgccatggccagctcccggtcgtcgaccggtacttcggacagcgccgccgacagcgaccggtaccagaaactgagcccccggccgtcgtggacgagccggccgcgccggtggtggcggatgtgtgcggtgggcgcggagcgcagatggcgccagccgaggcgccgggtgatgtcggccatggcgaacccccttcatttcgtcaaaccgacgataacgaggaaccctcttaccgtcaaggtgacgaaaatggggggcgggcgcgatccgcggagcaccgggaaaagagaaaggcacccaccgcgtcgcggaggtgcctgtccctgcgcactgcaggccacgcgccaacatgagcctgcgtctgtccctgttcgccggggtcggagccagtagcactcagggatgacgggcggggcgccgtgccaggcgcccgccacgccagagaccgtctcatcagacccgggcgcgggcaagtgcaactgggacgcacccgagccaacgaacgggcccgaaccgtcgcaccgcaacggcacccagcacgtcctccctggtcgcggcgggcggtgtaccagaacgcgacagccggggaaaaactgcgggccgggacgcccgcgagccaaccacccgggcccccttcccgggctgtccacgaacggcccggcagctgggatgctcggttccaggcatcacacccggcggcgccaaccgccctgtgagacaacgcctttggagccagtagcccgcgtcctgccggcctgcgacccatgccggcagggcgcacgatcaggagatcgcgccatgccccgtccccactcgtccgccccggcgagcccctccctgcccccgcccccgccgcaggccgccaccggattcggtcccgctcacgcagccgtcatcatcgccttccttctcaccgccgcactgctggccgttctccacatgcccgtcgccgacgtgctgtggctgatcggcggagccggagccatcggatcgagcgtcgtcctcctcagcgtcacgggaggagccggacggttcggcgccgcactgcgcgccctgctgggaccggagaagtagcagtggcgcgccccgagaagcccgtggaccgcagcgtccccgaacacgccgccctggccgacttcctgcgcgccctcagggccgcctcacaggtgacctacggccggctcgcatccgcggctcagctgtcaccggccaccctcaaacgggccgcctcgggagccggtgtgcccaaactccccaccgtcctcgcctacgtcacggcctgcacaccgcccggaacggccggcgccgcggacgcggcggcccatgcacggcttctgtggcggaaggcgcgctacgcctcggtcctgccccgctacagctaccacgcacccgatccgaaactctgcgccacggcggacgatctgcgcagcagcctgcgcgacctccacctgtgggcgggccgcccgaccacgcgctccatggaaggagaggccggaggcctcggcatcctcccgcggtcgaccgcgcatcgcatcagcctgggcaggacactgccgatctccgagcgccagatgcgcagctacctgaccgcatgcgaggtacccacccaccgccacgaggactggacgcaagccctccggcgcatacgcccggtcgccgagcggcccggcgcacacagaaccccacccgaccgcaaccacacgggccaccggggccgaccccgcggccccatccgtgcggccaccggggaggcgcacgatctcgcggcctttctgcgccacctggtggacgaggccggcatcagaacccccgagctgagccggaagctgcgcatgcccgtgtcccgggtctccgtccacctgtccggccgcgtccctccccgcgtattcgtcgtggacctggtgagggcggtcaccccgcccgcagtcgcggaacgccggctcacccaggccatgtccctgtgggaccgagccgtgaagccgggcgcgagggagcctgcggtctcgtccggcgcagtcgtccgaaccggctcacgcgagatcgcggtgtacgagcggctctcggcgtcactggaacagcagcaggcgctgcggcagtcgatggagaacgcgcagaggctgaccatcatcctcatggccatgatcggcaagctccaggcggacatcgccaccctcgaagagaggcgattccgcctgagcgacacctcgccctcctacgccgacctcgcggagcgcctgcaacgggcccgggagcaggccgagcgcgcacagcaggccaggatcagggcggaagaactggcgttgcgactcctggagcggctcgcgggtccccgctccgggctccagctcgaacgggccgaccggccgcaggagtgcctcgggcccgtcgaaccgctgacggggaccggccgggatgccgccgcgcccggccatgacgacatcgacatcgcactgttcagggcccggcagatcctcgaccagagcgaagcggggctcgaacacttcgctgacgatctggggccgcaccgcccgggaaaggctgcctagtacccctgtggaggccgtgagcgggcgtcggcgcccgctctccttgcttcagaaccggccggcggacccggctgggtccgccggccggtcctcgtcacagtcgtagccgcactggaaaccgccctgtgccgggccggaaagcgggcatgcgtacgcagaagggcctgccaaagcgttgggacacccatgggcagaagaaccgtcgcgcaggaagccgccatcgggccggacctgaacggccggcagtgaacagccagagctgttgtcagaaaatgaccagcttctgctgcgggccgtcctgcgtctcttggacgaagacggaaccgccgtcgctcagcacctgttcgatgtaggcgtagagagacagagctcggttgatgctgtccgtcttgctgtcgcctgttagttcgactgcccgatcgagcgacctggatgcccgtgcggtcagattgacggtgaccctgtccagtggactggtccctcgcccagaagcggctgggcgacctccgtcgacagtggtgccagcactccttggcatgacagcttccttccctctccgacttcgacctccgcgttgcctctcaagcgggccggaggtcctgcatactgccgcctcaaacgccaatttgatgcggctggtctgcacagcatgcgcttcctgtcatcacaagtcaagcgattgatgccgcttgggggcgtcacgttcgatgtgcagcccaaggcctcttcgggcgccggcggcgcccgtcggcgcacccggcaaccgcgccgtcccggttggtccagaagctcgatcggtgctgtccggcagcccttgagggtgccttgagcggcgcccgccggcgcccgccgccagtcctggaccgaccccctcggattcgattgcactcgcatatcaagcacattttatgcacggtacagctggttttcgtctggtctttatacagacatcgtgcgcatcgctggtacgctctaagcgggacacccgtcgccgccggcgacaggcagaaagaaccgttgaaaattaaacagaagggctgaaatggccacgcgtaagtacacggacaccgacctctcgcacgaggagccgacgcaccgggccgacctggggatggagcgcgtcgacctcgaggtgggtaccggcggggtgcgtctcaggagcaccctgcgcagtaactccccgatcgcgcgcgccgtgcagtgtctgctgctggcgatcgtgatcctcggactccccgccggggccggggcggtggcgatgtggctgggcctcggacccgtcgtcatcggcatcttctccggtaccggcctcgttgcggccgtcgggatcgttgccttcgtctacaagaagcccggtgccgacgccgacaggcaggagccggcgagccggcctcccgcccagcggcgcaaccggaagaccaggcgaggaaagaacaactcgcgccgctaaccgatttctttctcctccaccagccggtgggcggagcagcagccgctgctccgcccaccggcctttccgcgttccccgatcgctcggcacggggcgagaccggcccgcttccggctccccggtcatggggacgcagatgttccggacacggacacgggcggaagccgcgaccgagaagcaccgggccggcggtggcgcctgtgatccgtccggccccggtgctgcggcgccgacgaccacggcttgacgatgccgaggcgagcggcgccgtacgcggcagagccgatgccattcccgtgaactcccgcatcccgcccgcgtcttcccgcggccggaagcacatcgcgacgatcgacgggcaccaccgatcagcgcctcgggcacctccccgcggtacgccccgttgccacccgccgtcgtgtgcatccgtaaagccggaaggcctcgggacgccccggaccgcaggcggcccggcgggccggtactccgctcgggtcggtccctccctctccggcgtcagcccagttgctcggccagtccgacgatgatgccctcggggccgcggacgtagcagagcagatagctgtcctcgaaccgggccatctcgccgacgagttcggcgccgtgagggcgcaggcgggcaacggtgtcctcgatgtcgtcgacggcgaacatgacgcggtgcgtgcccagaatgttgtgcggccggttgcgcggcccggcgctgaccgccgcggggctgcggtacttcgcgagctcgatccggctgagaccgtccggggtccggaccatcgcgatgtcacagcggacgccgtcgagcccggtgcaccggtcggcgacggggccctcgacctgcgccctgccctccagctccatgccgagttccacgaagaacgcgacggcggcgtccaagtccccgacgacgatgccgacgttgtccatccgctgaatcgccatgctgcttcctccttcttcctcgtgcagccggtggtggtggccgctgatgccccggggacggagccggtgacgcgttctcgacatccgcagccgcagcgcaccgaccccgcttctccatgcaaccccggcgatcggcagcgtgcgcgctccggcgtcgcgccgccccgccggttcaccgtgccgggtcatcccgggcgggcggggttccccggtgaacgggaacacgctccggtacgttccctgtccggccgaagcccgccggtaccgccgcccggtgcgctacccgcgtccgcgggaggacctcacccgtccgaaggggggtgcggctgagccggttcgggggcggcggtctcccagggaggaggcatgcgcgactccgtccacgcggccaggtcgtcggcgtcgacgcagacgatgccgcacgtggcggcgtactcctgggccggagcggtgaaggagctggtggtcaccaccacggccacatcggcctcgtggacggcgaaacaggtaccgccgaagcgctgcaggtcctgcgagccgacccggttgccctcgccgtagtgcttgcactggacgacgacgcgcaggccgtccgccgtcgtggcgatcacgtcggcgcccaagtcgcccgccccgcccacgacttccacctggaggcagccgtcccgggcgcacagcgcggcgatcgtgtgctcgaagccgtcggcgtccaccgccgcgtgatccagcgcgccggcccccacctcgggcacatcggccgcaaccgccgcaggcccggcagcggcaggcggaacgaggagcgacgtcacggccggcggatctgcggacggcgggtacgcggggccctgcggatacgcggtcgccgggtaagccgtccccggacacgcgggggcgcggcgccggacgggggccaggccccaccgggccagcgccaccccggccaccaggacgatcaccgtgacgatcggcgtcacaggtatgccgccacccgcccccgcccccgccgccgtccgtacgaacacggccagtccgcccaggcagatacccacgagcccgaccgccagcacgacgtcccgccccacggacgcgtcaccctcacccgcacccggaccaccccgacggcctcccgatctcgccatccaggcccctccctcactcgttcccgcggctggaccccgtacgttccctcgtctgatcactcatcccggatccaaacggtcccgccggcgcggggtgcgggagctcacccccgctgccatgagctgcagccgtgcaggttccctcgcgttgccgagccggtactcgggcaaggggccgggtcccgcgggggttcggaggagcgctcccagcggtacggtccggccggatcggccgccggttcctccaggtacaaggtggtcgcgccaccgaccaggaccagtgccgcccaactgccccataaccaccgtcgtatcggcgttgacacgttcatctccctgttgcgcagctgtccttcggactccgggtgcccatggtcgaggcagcggtggaccgctgtcagaccggcggcgttgccgcagagcaccggagcccgtcacccggtgcgggccccgcgagcggcgcggcgcggccgttccgcagcgggcccgggcccatcgcagtgtaaaaaatggtgcacatctgcacgcctttgatgcaaccctggtgcgcatcgtggcccccagtgctccaaggaaggcatcaccatggatcagcagcagcttcccgcgcaccccgacagcgagcggtactcggtgaccctgtgccccccggcggtcaccgtcgtctccgagctgaccgccgcgagcggcgtcagcaagtccgacgtgatcaaccgggcggtgctcctgctcgggttcatcgagaacgagcgggccaagggcaacgacctgatgatccgcgacaccggcggcgccctggagcgcatccacatcatctgaagcacgacccgcaggccgccctgccgcgggctcgcgatcaggaacgcggcgataccgggccgccgagcggcgcggtcaaccgcgaccgccagccttcctccgtcagcgccaccaactggagcgcggccgcacgggtgcgcagaggcagcaggcggccggccgccgcgcggacacgggcggcggtcgggtcgtccgcgcccatggcgaccgtgacatgcgcggcgggccgctccccgaagcggcccccgtacgggcgcaacccgggccaccgggcgcggaacgcatcgacgaccggctggagttgcggaacggtgacgccgacgaagccggacgccgtcacgacttcctccatcagcagatcagcggccggaaaactcgccgccagggaacgcacgcccctctcgtcctgacccgtcagcgccgattccggtacgaaggggtagagcagtgagacgtgcgccggcatcccccgacgcaccagagccgggtcgatgcgccgcgccgcgtcgaggagcggcgcggcatcgggcagaacaatgacgacggcggtggttcctggctctggcaccccgtcatcatcgcaggccaggtacgggattggccctgaccgaccggggtcagcggaataagccgatggtctcgctcacccagatgtcacggccgagggccgcggcggccagcacccgcacgggccgccccatggcgagcaactgccgtgccaagcaacgcccgacgatccccgtcgggctgttgccctcgtccttgcgcgggccgacgacggtcagcagaaaacggcgttcaccggccggcgggaccggttccgcgtgatcatcggccggaactccggcggcgatgccgtcacgctggccgaaatgcgcgcagcgccgcaggggaacgggcgcaggctctccccaacccgcactgtccatggtccacttgagggtcggccgtgccacgagggggagcagcacatgtcggaagtcctggtgaccacagccgttcccggtgagggcagggggcgtcggcgacgccgttggcccgtaggggcggttcccgtactcgccgtcctcctcgcgggtacggtcgcgtgcggcggggacggtgggggcgggcagccgccggccgacaaggcagtaccgacggtggccggccagagcccctcggcgaagacggagcacaagagcctggagatgaagggcctggtcgcgctggtgtccggcaacctcaccgagctcgtggtcttcgacgagacgaccggcaggaccaaggcgggagccttcctgccccagtacgccgtaccgagcgcgtggaggaggcaggccttctcgccggactggcactccgtcgtgtggacgacgaagggcggcgacctgtacttcggggagtacacgagcggcgcgggcccgaacgggaactacggcgacacacccgtgcatatagggggtaagccgacatattcgggtggcaagcccggatacacgcaaccccgcttcggcccggacgggaagcgcgtgtacttcctggccaacaacgacaaggtgtactccgccgaccccaagagcccggatgacctgaaggaagaggcgaccctcgggcccggaacatccgcgcaggagaacgagctcgcctgggacatcgccgcgtccggccaggtcgagaagcgacaggccgcgtcccccggacgcgacagcgaggtgcccgccccggacggcaagaggaccctcgtcaagaacggatcaggctggttcctgaaggaaacgggcagcagcgccgagccgaagttcctcttcgaacacctcctcgactacgacgagaagccactggcgaacaagagcgtgaccgtcgacgtcctcggctggtactgacctgccgccgccctgacgcgtggtggccgccgcgcacacgggatcgccgcccaagacacgacgtcaggacggcgtcaccggctggggaggagcacgcggatgcgaggccgcaggaccggctcagggccgtgagccgggtgcgggccgttcacgggtgggggccgactgcccgtcacaaggccgcgtcgaccggctcgggatggttcgactggatctgcgccacggcaagaggcatgaacgacatgacggcatcggcctccggctgggtcagcgagaggacgctgctgatgacgacgagcgaactccccacgcgcaccacggtcgcgtcggcacgttgcgcgtcacccgtggtgcccatcgtcaccgacgcctggatgacgaggctctcgtccccgagccgtggaccttcggcgacggcgaaaccggcggccacggccggctcccatgacgcgcggggcaggtccacgctccggcaccggcccaccaggtcacgcatgtcctgcagcgcctggtgcgcaccgtcgcccgggaacgagtagagcatctccgatccggggatgacgccgttcccggcggagtgcccgccgctgaacacggctgccgcagacgcagccgaggccgccgtacccgcgtccgcgacactctgcccgtcgagaaggcccgcgcaggtcggcggtgtcgccgccgcgcccggtgttcccttcgggcgctccttcgcgggctccgccacggaggtccagccacccggcatgaccgcgggcaggaggtgtgttcgcagctctgcagccgacatcggcggttgcggcgccgatatcggcggttgcggctccgtcgggcttccacaagccgtgatcgacgcaagcatcacaagtccagccacgcaccggatcccggagtcggtcgcctcggcgcacctcccacctcaagtgatcgaactgccaggagccggcaggatagcggtgcctttgaccgtcccggcggccgggaggcgccggacccggaccaccggcaccgctcacgcggcgacgtcgtcgatgccgtcacggccccgcagcgcgctggtcgacgcgtcagccgtcgaagcggtggcgggaagcctcgatgtgaccgaggtgccggtgggtccagtcgcacagtccgtcgatcgtcacgcgcaaagcccggcccgggccggtgagggtgtactcgacccgcggcggcacgacggggtggaccgtccgctcgaccagaccgttgcgctccagcatgcgcaggttctgggtgagcatcttgtggctgatgccctcgatctcgtcccgcagcccaccgaagcgcagggtgcgctctcccagggcctcgatgatcaggagagcccacttgttggcgacgtccgagaagatctcccgggccagggagtcggcgcgcctcacgtccccgtcgtcggccgagccgccgagctgcttggtcaccacaaggttccccagtcaccgaaaagtgcgttcttccatgtcagcgatcactctcctacggttcctgagtaaccacaagagagcacgtaagccacgcgcgccacgcagcgcactctgacaaggagacagcagcatgcccgtcaccctggtgaaccccggcggactgccgaagatcgatgcctaccggcaggtgtcggtcgcgaccggctcgaagctggtcttcatcgcaggccaggtcgcctgggatgccgacggtgccacggtcggcgagggtgacctcgccgctcaggtcgagcagtgctacctcaacctcaacaccgccctggccgaggtcggtgcctcattcgacgacgtggcgaagctgaccgtctacgtcgccgactggacccccggcaagatgccgctgctcatggaagggatcacccgggcggtcgcgaaactgggcgtcaccccgacacccccggccaccctgctgggcgttgcggctctggacgtacccgagcacctggtcgagatcgaagccaccgcagtcatcgactgaacaggtcctgtgaacaggccctttgggcaggccctttggacaggtcctttccgccggggccgaaccgagtccgcgccaccggcggcgaggcggcccccggccgaccgggctagcccgcgccggtcgcgccgggtggcgggaggtgtcgggtgatccggtcgaagagctcgaccagtggttcgctgatgtgcctgccgaactcggtgagcccgtaggtgacctgaggcggcgtcgtgggctcgaccgcccgccacaccacctcgtcccggaccagagcgcggagggtctgggcgagcatcttctcgctgatgccctggatgctctcgcggagctcgtagaaccgaaggtccttgctccgcaaggagatcagcacccagatgccccaacgactggtcacgtggtcgaccatgtcgcgcgcggggcagtccgtgtgaaacacgtcataccgcttcaccgcatcaccggctccgagctgcgcgctacccctcatgtgaggagcttacccacaggtatgtccttaccagaagttagtcctcctcctagcgtcaggtgcgtacaagtcacggggacgaaggagctgatcatgatcgtggtgaccggggctaccgggaacgtgggccggccgctgacgcgggcccttgcaaaggccggcgaggaagtgctggcggtatcgcggcacaaggcgccggtgccggacggcgtccgccgactggcggccgatctcgccgagcccgccgctctgcagcctgtactcgcaggggcgaaggccctgttcctgctgctgtccggggacctgcacggtcccggcaccggcccggccgagaccgtcaaccgggccgcggccgccggggtccgccgagtcgtcctgctctccacacagggcgtggcgaccaggccgtacggtccgacacggatcgcgatgcgcgccctggaggaaacggttcgggaatccggcatggagtggtcgatcctgcggccgggcggcttcgcctccaacgccctgtggtgggcccctgccgtccgcgcggagcgggtcgtagccgccccgttcgcggatgtcggcgtcccggtcatcgacccgtgggacatcgccgaggtcgcggcggcctgcctgctggaggaccggcacctgggcggcgtgtacgagctgaccggcccggaggtgatcaccccccggcagcaggcacaggccatcgccaccgcactcggctcgccccttcgcgtccacgacctcacccgcgacgaggccaaggccgccatgacccggaacatgcctgcagaactcgcggacgacaccctggacatcctcggcgccccgagcgacgcggaactgcgcatcagccccgccgtccagcaggtcctgacccgccccgcacgccccttcgccgactgggccgcacgcaacgtcgccgcgttccgctgagccgccgcccgcgcggggtgggccccgcccgggcgttcgcagggtgtggtcggggggccggcggctgtaggcgcgtgacctgctaggttgaccgttcttttgtcaggcgcggctgggggagcaagggtgatggggcgcgggctggtgcgatcggcgacgggggcgatcgggaccggtgtcctggcggcggggctgatggcctgcgggccgtcggaatccaagcagaccccagcgggcaggggcgtgccggatccgaagccggccgcgagtgcgagtgcgagtgcgggtacgggaacggccgccggtgtcaaggcagtcggttccgtcggcggcgaagacaccccgtgccgcctgcccgtctccttcgacctggtccaggactggaagccgaaagccgtcacgcacgccgaggacgaccggttcgcttccctcttccagcagggcgggatgaccctcgcctgcgagatcgacgccaagcctgccgggaacatcggcttcctgcgcgtctgggtcgccgacgagccggccgcgcccggagacgcccgcaaggtcctcgaagcgttcatggccggcgagaaggccaagggcaccccggtctacaccgacctgaaggcaggcccggccggcgccgcgctcccggccgtccaggccgcgtacgagaccgaccccctggacgaacccaagaaggagagcgccttcgccgccgtcaccccgggcggcgaggcggtcgtcgtccaactgggcgggctggacagcggcgagcacgatgagatgctgcccgccttccggctggcccagcagtccctgaaagccgccaaccagcgatgaccgccccacggcggaacgtggtctcgcacggctgacccaccgctcacccgtgccgcagtacgcatacggtccccggccgacgggcatccgtccagggtgatcggaaccgaaccgccccagggccaggacccgcctccgcaagccgtccgggccggaccggtccgcgccctgcacgcgtcctaccaggccctcgcggccgtcgtggccccgctggaggacgaagactcctggcagcccaccggctgtacgggctgggccgtccgggacctgctcttccactgcctcatggactgccagcgcgggctcgtggccctgcacacccccgcgcccggaccggcggaccgggacgccgtcacctactggagcgacaggcgccccgatagggaaggcgcggccaacggccgacgctgggcgcgggtcagcgccggcatgttcctgcatttcggccaactgcgcggactgtacctggagaccgcggcagccaccctgaacgccgccgccgcgaccgaccccggcctcctcctctcgacccagggccacaccatgaccgccggcgacctgatgaagaccctcaccgccgaggcgaccgttcaccacctcgacctcgtcgcctcactcccacacgctcccggggcctcaccgcccggactggcatgcgtacgtgccaccctggacggcctgctgggccgcccgctcccgctcgactggagcgacgagcactacgcacgcgccggcacgggccgcctgcccctcacgaacgccgaagaacgggcactgggaccggacgccgcctccttccccctgttcggctgacaggaccggtgtccccaggacgcgcagtccatgtctgcccgatgccggcggcggcggtccttcgcgtccaccatccgttccggccggttccggacgttcctggacacccgccggtgagcccgcttccctgcggggcccgggaacgggcgctcgggtgaacccgggcagactggccgaaactggcatcgatgagataggtgccttaggcatgtaatggagtccggcgtgaacggaaccatcgcttgcgaggtgttgctttccatgaccgaggccatgtcccatgccctgccggatgtcgtcgccttcccccaggaccgcacctgcccctaccacccgccggccgcgtacgggccgctgcggcagaaccggcccctctcacgggtcaccctcttcgacggccgctccgtatgggtggtcaccggccacgccgaggcgcgcgccctgctctccgacgcgcggctgtccagcgaccgcaccaaggaggcattccccgcccccacccgccgcttcaagggcgtccagggccggcgcaccgcgctgctcggggtggacgaccccgagcacaaccggcagcgcaggatgctgatcccgagcttctcggtcaagcggatggcggccatgcggccgcagatccaggagaccgtggaccggctgatcgacgccatgacggcgcgcggcacacgggccgaactcgtcagctccttcgccctgccggtcccgtccatggtgatctgctccctgctcggggtcccgtacgcggaccacgagttcttcgagggggagtcgcggcggctgctgcgcggccccgagcccgccgatgtcgaggacgcccgccgccggctggacagctacctggaggccctgatccggcacaagcgcaccgatccgggcgacgggctgctggacgagctgatcgccacccggctggagaccggcacgaccaccgtggaggaactggtcgacctggctctgatcctgctgatcgcgggccacgagaccacggcaaacatgatctccctcggcaccttcacgctgctgcgccaccccgagcagctctccgaactgcgcgacgacccctcgctgatgtcggaggcggtggaggagctgatgcggttcctctccatcgccgacggcatgctgcggatggccaccgaggagatcgaggtcggcggcgtgacgatccgccccgacgagggggtggtcttctccacctccgtcatcaaccgcgacgagacggtcttcgaggagccggacgcactcgactggaatcggcccacccgccaccacctggccttcggcttcggcatccaccagtgcctgggccagaacctggcccgcgccgagatggagatcgccctgggcaccctcttccggcggctccccggcctgcgcctggcggccgacccggacgagatccccttcaagcccggggacaccatccagggcatgctcgaactccccgtggcctggtgagcggcatgcagatctcggtcgaccaggacatctgcatcggcgccggccagtgcgcgctgaccgcgccccaggtgttcacccaggacgacgacgggctcagcgaggtgctcccgggccgcgaggacggccacggcagcccgctcgtacgggaggccgcccgggcctgcccggtctcggcgatcaccgtcgcggagggctgaggctccgccggaccggcgggcccgcagagccgcaccgtccgtcggggcgccacacccggcgagcgcccgtcaggggccgggtggtgggtggtgggtggttgcacatgccgtagcggcatgtggtgtcgtcgagggcaccacagcacgaaaggccccgtctgcgatgtacccctccgccacgcctccccgcgaggtcaagatcggcgatgccgccgccttcgccggaaccaccccgcgcgccattcgtcactaccaccagatcggtctgctgccggagcccgggcgaggcggagacggccgccgccgctacggctacgacgacatgatccgcctgctgtggatccgcaagatgtccgaagccggcatcagcctggacgacatgcgggccgccttcgacgaagcccgggacgtcgaggacgtcctgggccggctggaggagaccctggccgcccaggaggccgacatcaagcgccagcgcgcggcagtccagcgcctgcgggccgtgggcagcccactgggcctgctctccccgttggtcacggaccggctcagccacctgccttccggcgcactgcgcccctccgacctggacgccctgctcgtcacagaacggatcttcgggccgctgggagccgcagttcaggccagcgtgttcatcaccctggcgacccatcccggcctgcgggccgaggcagaccgactcgacgcggccgacgccgccctcgatgacaccgtcgacccccacgacccgcaggtcggggaactcgccgcgcggcactgcgcccaccacaaggccctgctccaggccattgaagcggccggactggacgtggccgaggagaagctcttcgagatctgcgacgacgaggcgagcggcgaggaggacgcccggatgagtgccctcgaagcggtgaccaagatgccctacggcttctccgcggcccggacgcggtgcgtggaactcacggcacggctccttgccggggacctctccgcaagcggctgaccgctggtgtggccgtgcgtgcggatcccggcgactgagccgggcccttcggtgcacgcgatgtgcggacaccatgccgcaacggccgccctccgcgccctatgactacgcgtcacgagcccgcgtgactgccgggttcgggcaggtcaggcgggccggcggagcttctaggatctgcggcatggcaacacgactcgtgcagatcaatatgaaggcccgtgacgactccgcgctcggccggttctgggcggaggcactcggctggggtgtcgacagcgagggacccggcgtgaccaacctcgaacccgtgggcttcgcctaccccgaccccgtggccgtttgcatcgacatcgtcgcccgcccggaacccaaaacggtcaagaaccgcgtgcacctcgatctggccaccacctcgaccgcccatcaggcggagttggtcgcgcgcttgaaggatctcggcgcgacgctcgccgacgtggggcagggcgacgtcccctggacggtcatggccgacccggaaggcaacgagttctgcgtcctggagccccgtccggtctaccaggacaccgggccggtcgccgcggtggtggtcgactgcaccgacccacgggagatggcgcggttctggggcgaggcgatggactggacgctgtgcgaggtcaccgacgagcaggcgaccatgcgctccgccaaaggcgtaggcccctacctggagttcgtccgcactcccgacaccaagagcgtgtggaaccgcgtccacctcgacgtccgcccctaccccggtgacgacctggccgcagaggcagcccgactgtgcgccctgggagccaccgcccccgattttgaccggtccgcaatctcctggacggttctggccgacccggaaggcaacgagttctgcctcctcacgcctcgctgacgtgagcggacacggggtgacctccgatcggcggtggccgtttccccgggccgccgtcacgttcccggcgtcctgggcggcgttggacaggcggccccggcacgcgtagcagtccgccgcagggcctccgcgtccgcgtcctcgtcggcggtggcgcgggcaccgggccggcgacaccgggccggcacccgtcgtgggcgtcccggccgccgatcgtcctcggcccggatgccatcgggcatgcggctgggggggcgatccagccggagttccagcgtgaggcggtgtggacagaccggggccggctcccagccggcggcccactggcaggcgcaccggcccgcgccgatagggtgcgggccggactgccgggaggggctgaggatgagaccagggcgaagactgtggatcacagggctggtgctggtgcccctgggggtgctgctggcggcgggcacgtggctgctcggtgactccgccttcggcggccacagcgtcggctccgatgccatgcggccgacgtacgagcagggcgacaccgtcttcacgaagaagatcgacggcaccgacgtccatcgcggcgacgcggtcttctactacctgcccgggcgctacaccgacaccgctctcgtcttccagcgcgtcatcggggtcggcggcgaccgggtgagctgtgacgggcagcaggtacgggtgaacggcaagccgctgcacgagacgtacgtcgccgggggcgaccccgtaggtgacggcaagagctatgacgtgaaggtgccggaaggccggctcttcgtgatgggcgacaaccgggtcaactcccgggactcccgctacttcctgtcggacggacagagcggcacgatccctgcggacgcggtccgcgagcgggcgttcgacggcgcgggcctcgccatcgcgatggccggcctcctgatcggcgggttcgtcctcgcgctcatcgggctcggctgcggtctggccggatatctgatcatgcgccggggccctcgggcgcagcccgcgcccgcgccgccctacgtcttcccgtcaccctgaccgtgcccccgacgcaggaaggtcacagccgcccgtacgtctcccgatcaccgtcgcccgcaccggggacctgccccgccggcatgccttcgccaccgggccggaactgtcagacccctgcgccatgctcaccggcatgaacgaagacgccttctggcagctcatcgaggactgcaggcccacagaacccgacccggacgccgacctccttgcggacacgctgaccgagcggcttgcccgatccccgttgccgctggtcaccggcttcgccgaacgactgtcatgggcgctctaccggctggaccgcaaggagtacggacacgacctgggcgcagacgccttcctctacacccgtgccgcggtcgtcgccgccggccgcaccgcattcgacagcgttctcaaagatcctgccgccttcactccttacgccaccgacctcgtctgggccgaaagcctgctctacacaccggaccgggcatacagacgcatcaccgggcaggagtgggaccgcaacacgcgctactcctacgagtcgtactcgaacaccgggggctggaccgattgaccggcacggcctgccgatggttccggactccaggagcccgagcggctcaccggcccgtctcggtgatcatgtcgatcaggccctgggccgtgttgtactcggagtcgatccccggatcctctccaccgtcaaaggtggcgaccccggcgctgcgggggaacatggcctgctcgtactcggtgagcgcggcctcgacatcgccggggtgcgcggcgagggccttgccgagttcggcgccgtcgtacatggccaggttggcgccctcgccgttcgggcccgcgaggtgggcggcgtcaccgagcagggtgacccccggcacccggtcccaccggtgcccggtcggcagagcgtagtgggggcgcaggaccggcgctgtgtcgccgtcggtgatcagcgcggtgagttccggtgcccagccgtcgaactcgcgcgcgatccgcgccgtggccgcggcggcatcggtgaagtctatggcggcgaaccagtcctgaggcctggtcagcgccacgtaggcgtgcagggtgtcgccgctctcccggtgggcgaaaatctccctgcccggcgagggagcgatcagcatccctccgccgaccgccttcgcggcggccgggtggcgggtgtcggcgtggaacaggtaggtctcgacgaacgacgtgccggtgtactcgggcgtggccgcggagagcagtggccgtacccgtgaccaggcgccgtcggcgccgaccagcaggcgggtgacgacggtgctgccgtcggcgaacgtcacctcgtggcggcccgagccgagcgcgcgggtgccgctgaccttgcgcccccaccggacggtgccggccgggagcgagtcgagcaggatctgccgcaactcggcacgctgcacctcggggcgtccgcccgtgccgtcgtcggccttgtcgagcaggacggtcccgtccgggtcgaggacccgcatcgcctggcggccctccaggacgatggcgtggaactgctccgtcaggccggccgcctccagggcgagctgcccgttgtagtcgtggatgtcgagcatcccgccctgcgcacgcgccgtcggggagggctcggcctcgtagaccgtgaccgggatgccgtggacgtgcaggacgcgggccagagcaagtccgccgagtcccgcgccgatgatcgtgacgggcaggtgcatggtgcctcctgggaacggggccgcccggtgagctccggccggccgtctcccgtacggtgtcggacctcgccgacaagccaccgacaccgaaccggcagccgccgatggacgaccgacaccgcacctgcgccaggtgggtgagcgggcgatcatcgctcacgcctcggtgagggcctgccgccctcacccgtcggcttgtactcgggcggcgtcgccgcgggggaggccaggcgggggagtcaggcgggggagccggccccgtggaaggcgcgggcggccagaccgatccactccgggcgctcccgggtgctccagcgggttcgagcggcgtgttcgacggcggcggctgcctcgtccacggtctcgccgcccaccgctgcggcggcgtctcgggacgcgaagccgaacaccccggcgggcaacgctgaatccacctcacacgccatcaggcccccgctggacgtctggacgtcccggcgggggcctgactgtgcgcccgggcacagcacccggcggcgggagttgacgaaggcggcgcagttccggcagcggcgttgcccgggggcggccgccgcgcgggcggggggtctacaggtggggcaggacgaagtcgtacccggccaccgagtgggcgtttccggcggggcagcggccgttggtggggtagccgtagtagtagaggccgtagcacttggggcagaagcgccagttgcgctgggtggtcgcggtctccgggatgtcgtgcgggaggacgaagtcgtacccggccgccgcgtgggcgtttccggcggggcagcggccgtcgtcggggtagccccagaagaacatgccgtagcacttggtgcagaaccgccagttgtgctgggcggtgggcgtctcggggatgttgtacgggaggttgaagttgtagccggccgcgtcgtggccgctgcctgccgggcaggcgccgtcggtggggtagccccggaagaacatgccgtagcacttggtgcagaaccgccagtcggcctggttggccagggccgccttggtcttggcgggcgaggaggtcttcgccggcgacgccgaggccggcccggtcgccgcccccaccgcggccgcggtgcccaggccggccgccgcgaggcccagcgcccgggccagcacggcccgccgcccgggccgcgactgcggatcctcatcacgcactgtcagaaaacccatgaatgtccacctctccgccggcggtggccggcgaatccacaggcgaagcccggtcgggcattcgttgcgccgagtatccgaccgtcactgtgcgtggtcaacggagcgcgggggtgcaccgggcccgcacggcgcgcccccgcgctcaccctcacgggtgcccctcgggctcaccccggcccggcccggcccggcccgcaaccgccacgtgccgggcggcttcggcccgaccctttgccggctcgccctgagaacggatccgggccggcggggtctggcggcctgcgctcgatcctgcccgcgcaaggggtcgttcaggaggggcgcagcccctgcaggagcagtccgatcagccttcgcgggtcgtagcgggggtcgctgtcgcgtccgatgcagaggttgccgatgccgcgcatgagttcgtacggctgcgtgccgggcctgatctcgccggcgtcggcggcggcgccgagcagctggtcgcagacgggcagcagccggtcgaggaagagggtgtgcagcgtggcgaagcgttcgctgtcggactggagggcgtcggcgaggccgtgcttggtgatcaggaagtcggcgaagaggtcgacccactggcgcagcgcgtcgaacggggaggccgcctcggccagcagcttcgggccggcttcggcgcaggcctcgatctggtggtggtagacggcggtgaccaggtccgcccgggtggggaagtgccggtagagcgtccccagtccgacacccgcccgggccgcgatctggcggatcggtgcgtcgatccccgaggtcacgaagacctccgcggcggcgtcgagcagcgtctgctggttgcgtacggcgtctgcccgcttgctgcgggcggacgctcctctggccgggcctgctgtgggcaccgcgctctccttccggcggccgttgacgaaacggatcagcgttccatattttaaatggaacaacgatccgcttgcaggttagtcgactgcgggcactccgtcacacccgccgtcgccgtacgcggccggcggcgggggccatcgaagggcatctgctcatgagtgaacctgcttgcacagccgccaccctccactcgcccgcccctgtcctctcggtcggcccggtggtgctgccggctcccggccgcgccgtggacctccaggtgcgtatctccgcgccggtgaccgggagcgagttgccggtcatcctcctctcgcacggtcttggcctctccaacaacctctcctcgatgaacgggtacgccccgctcgcgcacgtctgggccgcacgcggtttcgtcgtcatccagcccacccacctggactccaggacgctgagcctggcccccgacgcctccggcgcccccggggccgctgcgcactggcgcacccgagccgaggacatgacgcgcgtcctggaccggctcgccatgatcgaggatgccgtcccgcagctcgccggacgcctcgaccggagccgggtcgccgtcgccggacactccatgggcgggcacaccgcgagcctgctgctcggcgcccggctcaccgatccccgcgacggaaccgaagcggacctggccgacccgcggatcagggcgggcgtgctgctcgccgcgcccggccggggcggagacgcgctcaccgagttcacggccgagaactaccccttcctcctgaccaccgacttctcgacgatgacggcgcccgcgctcgtggtcgccggcgacaaggacgactccgccttcctgaccgtcagcggcccggactggcacaccgacccctacgtcctctccccgggccccaagtccctgctcaccctgttcggcgcggagcacgggctgggcggggtctccggatacgacgtcgccgagaccacggacgagaaccccgagcgggtcgccgccctcgcccggctcgcctgggcctacctgcgcagcgagctctaccccggggaccccgcctggcaggcggcccgcgacgcggtgacggccggccccaaccctctcgggcgggtcgaatccaaggagaacccgcgaccctgacggcgccgcacgtgacagcgcgaccgcggcggccgcgtcctacgtgagggggagggggcagaccaccggggcgcgggcggtgtccgccgggtgcgccgagccggtcgccgcacctcgcgtaccagcggtgatcacgcctgcgtccggccggtgccgtggtcgcgccggaacgaggaacggaggccattcggcagcgggtttcggccgcttgtccggatattgcatgctacgggagagggacccggggtgatcctttcggtggattcgctgctgcccgccgatgcaacacggtggccacatcagcgatttcaccggaagaaggatgacacgcctccatgaaacgcctcgcaccgctgctcgccacgatcggactcgtcgcaacctccgtgcccctgctgacggccacccaggccgctgccgcccagatccccggctacctgcgccagcaaccggactggcaccgctgcagccccgaccggccggtgacgtacgagtgcgcgaccctcaaggtgccgctcgactaccggcacccccagggccgcatgctcgaccttgcgatatcccggatcaagaccgagaacccgggcaagcggcggggagtcctcctcttcaaccccggtggccccggcgcctccgggctgttccggccgctggacctgaacacgaggatccccaaggacgtccgggaccagtacgacctcatcggcttcgacccgcgcggcgtcggcaagagcagcccgatctcctgcggactgaacccggacgaggggggtctcggcggcgcctaccggcccgagaccttcccctcggacgtggcctgggcgcgaagcgtcgccgacaagtgcagggagaagtccggcgacgtcattccccacatcaccacccgcaacacggcccgcgacctggacgtcgtccgtgcggcgctcggcgagcggaagatctcgtacctgagttactcgtacgggacctacctcggagcggtgtactcccagatgttcccgcagcgcaccgaccgcttcgtgctggacagcggggtggacccgcagcgcgtctggcgcggcatgatccaggtgtgggccaccgaagcggagcccgccttcgcacggtggacgcggtgggccgcggagcgctcggaccgatacgggctcggcaccacgcccgaagaggtgtccgccaccttctgggccctggtggcccgggccgacagagacccgatcgtccaggacgggcagaagatcacgggtgactacctcaggtcggaaccctcgctgttcttctccccgtacggagcctcggccgtcatcaagcacctcaagtccctggccgagaacgggcccgggccggcggacggcgacgcgccggatctgaagcaactgctcgccggctcccggccctccgagccgaacgcagcggcgccgaacgcatcggcgccgggcgcggcggccgccgattccggcggcgacggcatggccgtctactggtccgtcgtgtgcggggacaccgacacctggccgcgcgaccccgatcagtacgcgcgggacgcggcacgggacaaggcgaagtacccgctgtacggggacttcgcgtcgaacatcaagccgtgcgccttctggcagcggccggttgagcccgcgacgcccatgaagacccgggccgacgtgctgaccgtgcagaacgaatgggactcccagaccccgctggtcagcggccagggcctgcacaaggcactgaagggctcacggatggtgctggcgctgggcggcgagaagcacggtgtgtacctctccgatcccgcttcctgcgccgacgccacggtcaacacctacctcgccacgggccggctgcccgccgcagacgtgacctgccaggacccgccgccgttcccgtagggagccgagggcggcggccggcccgcgccacgccggtcgagccggctagtacgggaggtagtagctgagtacgtccgcggtgaggggagggaagagcacctggaacagctcctcgtccgcggagtagacgtcggggcggatccgggtcagcccctcgattccgagcgggccgaacagcagggcggccagatggtcgggcgccaccccggcgccttccaccgctccgggcgactgcaccgggccgccggtgacgacctcaccgagcccgtcggcgagaaccggaatccggtggtgggcgccgaaggtggacaggacgatgtcccggccggtgcggtcgatcccggccgcggtgaggcgctgccagaacagcggacgcagcctgtcgagcagcgccgcgacatccgggaggcggatgtagtactgctctgcgttccgccgcggttcgcggtcggtgaactcctgccacgcgtcggctgtcacggtgcccgcccgatggacgacctgtacccgggtgccaggtgccagggaggcgacgccactcaggaggtcccgtgccgccgccccgtcgcgtgccgcggcctcggccaggagcatctcctcaccgggaggcgtggtgcgcgcggtggcaatgaccgtatcggcatgctcgagaacccagaggttgctcgactcgtggtccaggagccatcgccagcacgccgcggagtgcggcatggccacatcgaacccgctctgggccgaggcctgcagggcagacagggaggggatgtccgagggccgggcggcacggagcgtgcccgttccatcgccgggcggcaaggcgttcacgttcagcacctgcggtatgtcgatcgcgtactcatagccgaacagccggtagaagtacgggattccgatcatcgcctggacgatgtggccacgggcggcggaacgctcgtgagcccagtgcatcaacgccctgacgagaccgcgtccctcgtactcgctgtcggtggcgaccagttccacctggccggcgggcagacggacgccgccgatgcgcacctcctcgtcgaggagcgtcgcggtggacacgacccggtcgccgtcgaccaccacggcacaggtggacaagcccgcgtcggggtcggtgacgaccagccggtggtcgacggcgtcgtccggctcaccgcgcccggacaggagcgcgccgatctggtcgagatccgtcggcctcgcctcgcgcagggtgaggccgccggccaacgaaacaggtgcggaagaaccgctggtcatgatcacagccagactgtggcatcgcccggccgtcccggccaacacgttttccgcggctcgtcgccggcgccgacgggcacaggtggccggcacccggtccggcgcctctggctgggagagcgctctgcgtggcgcccttgacggtgccgccgacagcgaggagaggagatccgccgcgccaccgcgactgcggacggctcgtggcccaggatctcgatcgtgatgacgttcccgtcgttcataccctcggcaacccgcctgccgtggaagcggtttcgcgcgtgcgccgggtgcaccccgtcgggtgctccggatcagggaccgctgccgcgcgagcgcggaccgaacaaccctccggggttaaaaccagagctaatggatacgggaatccagggttaaggtgagctagggtcgaggtatgccaaccgaggatgagctgttcgcggccgtggacgccctgctgaccggtgagcccgagatgccgccgccggcggagcgggcccggctgcgcgaggcggcggggatcacccaggcgcgcctcgcgcaggtcctgcagaccacgacccagtcggtgaagaactgggaagcgggacgcagcgagccgaggccgccgcgccgtcaggcgtaccagcggctgctggacggctgggccgcccagcagcccgcccagccgagcgtgccgatgcccccagcaccgtccggcaggcccgcaccggccgcccccgcaccgtccggcaggcccgcaccggctgcccccgcacctgccccggccgccccgtcagccgcgtccggcagtgcggccgttgccgcatccgtacaccgtccggcccctgcgacgtcgcggcgccccgccatgaagaagaaggccgccaggcccgccaccaccacagcggccgccgatccccggttcccgcacggcccgctcgccgtcctggacggtgacggcagcgcgtacggcctgaacgggaccgtgctggactgccccgccaccaccatcaccgagttggtggagtggacgctgaaggagtccgggctcggcgccacgcgcctgaaccacaacggcaaggactccgacccgctgatcgtgctcaccgccgcggccgccgtgaagctcggactcccggagcgcctcgagggccgcgaggagcgccgctcgctgcgcctggcggaggaccaccccgtcgtgcagcagatcggcaaggcgaagtggcagctcacgcagcgcggtttcggcccgtgggcgcgcgtctaccgcaagaccgaaggcagcgcacggcagtgcgtgcagctcgcggtcctgtcctgggacgccctcgacacccgctcgtggccgggcgtcgccgccatgcacccggccggcatcgccggcgtcctcggcgtctacgcccagcgggtcatcaccccgcgcggttcgaccgccgtgtccgggctggagctgatgaccgccctgcgcccgcccacccgggccgtgcaggacaacgggacgtgggtgtcgggccacaaccccggcagcctcggctcggacccgatggacccggcgcccccggaggccatcgccgagcaccccgtcgtcgtccggtccggctggagcgggggtttcctgaacgaggaggcctaccagtgggtccgcgaccccgctctcctctccgacgaggagtgcctgctgccgtacgcggtcggcctggacctcaacaccgccttcctcgccgcgtccgcacgcctgacggtgggcctgtccgcccccgaccacttccaccggccggtgttcaacaagaagatccccggctcctggctggccgacctctcccacatcgacctcgacccgcgcctgccgtcaccgttcaccccggacggcacccgcccgggcggcccggcctggtaccagacccacaccctcgcctacgcccaggaactcggccacgacgtccaccccgtcgaggcctacctgcgccgggagaccggcgcctacctcgacccctggcacgaccgcctcaagaccgcgtacgtggacacactcgccgacctcggcgtcaccgcggatctcaccgacgccggcttcctcgcggcgatggaggaccaccagcagaccgacccggccatggccgccgtcctcgccgcgatcaaggccacggtcaagggcggcatcggcaagctccgcgaacgcccccagggccgcacctaccgcgacggcgacccctggcccgccatgcagcgcccgacctggcgccccgacatccgcgccgccgtcatctccaaggcccgcgtcaacatgcaccgcaagctcgccaacatggtcaagctcaccggcctgtaccccctcgcggtcctctccgactgcgtcgtctaccccagccccggtccgtcgccgctggacttcctgccctacgccgcctccggcaagccgctgatgggcggcttccgcctcggccccaccccgggcctggccaaactggaaggggtgcaggagatggcatgggcggtggacctgatggagaagggcctcaaccccgcccgccacatcaagggcggcgacgccgtcctcgacgacggcgaatagaaccaggccatggcctgcggtacggacttctgcgtcgaggagctgaacagctgtgggagagatcgaggacgccatcgtccgcgccgatcaggaggccttcaccaaagccccgcccaagaccctgaaaggccggatcaacttcctgctgaagcagctcaagacgaccaaggcggtcgccgccgagctcgggctcagccagcggtcggtcgagcgctaccgcaagggcgaccgcaagaccccgccccagcccgtcgcggagcgcatcgacacggccgtacgcgcccgctggcagcccgtggtacggggccgccgccgtaaggaggccgccaccagcaccggcatcaccgtcgagacccgcgcccggttcggctacaccgcccccgtcggcaccaccgacgacggccgggtgcgccgcctgaccgtccacctccccgccgcctacgcccaacgcctgttcgacgcccgcgcacagggcgccgccgaccgcgacctgcgggcgatcgtcgccgagggactgcaggagatctacttcaaggacggcggaacccgggccgacgagctccgggtcgagctcaccgacatcgactacttcgacgtctccttctgaccgcgacagccggcacacagacatcgcgcgcgcgtgcctgacggtccggaacggccggcccatcccgtaccgggtcgtgccgcaggggctctaccggcatgcagggcagcggatgtgtactggagtcctgccgcatcgagggggaggcatgccgcacacaccggatccggaaaccccggagccagagcatgaagaggagccctggctcggcagtgaccaggtggcgaagctgtggccggtacgcaaggactggctgccgggcgccgcccgacgcgcggatgtccgcgtccgcagcttcggcggggcaagccgcggcacgtggggggcggaaccgaccttctatcacttccacccaggggacgtgcgcagggccgcgccggccatcgccgagggacgcgtcgacatcccgtcggactggcgcaccgacactcccgacggccggcgggcggagttctggggcgcgctgagcgcccgtgtcgccatcacgctcttcatcgcggccctcctgtgcgggctcctcctcggcctggccacagtgatcttcctgctgacagtggaatgaccaccagcgccgcagccgacgggcagcacgcttcccgccgttctcctcgtcccctcggaggaggctgcgttcagcggtccgtccgttccggcccgctccccagccggcggcgggccgtcccgggcacgggctgctcggcagcggcctgcggcggatcctgccgctcggggtacgccggttcggcggcgaggcggcggcgcaggcctggcgcgggcgcggtgtcggtggtggggcgggggccggtgcccagggggcggcgctcgatcatcctcccagtgtgaccctgccgttcccaccgggaacacccgggcctgcgcaaccagaacacccctccgacgcccggatcagcggcgggggtagacgaggatgaccggcgccgcaacacctcgaaggacaaccggcctgcccctcacccgtccggccgcggccggccgcgtcccgaacggccccggctgacttcccgccctggattcgacgacgtccgtaccagtgcgtgcgaggcggccaaccaccgcccgacccccgtcgacgcgtggcgagcgaagggcaggacatgaccggccgccccgacatcctgctgatcgtcaccgacgaggagcgcgcctggctgcctggcagcgcctgggcgaggctccgttcaccgacggctcggcgcggcaggccctcctccgctaacgccggcaccgcgcacgccctggaacggaggtgcaggcgcctcaccagcaacggctccgtatcatccccgcatgtcctggatacgccgccgcccgcgcgccaccgagccccacgcgggccgactgcccgatctcgacttcctcgccctggtccgcgacgccctggaggaggtcgcccccggctgtacggcgggcgccggactcaagggcaactcgctggaaagcccgcacggttgggccgtggctgtcggaccggcggggcacggggacgagcggcactacgacctgatcgccttcccggacgtgagcatccagcccgacgtgccctgcttcgtggactgcgtcgtggtggtcaccaccccgcgcgacgcggtcggcctctgggcccgttcggccggcgcctgcctgctcgggctgctctacgagcatgaggagctcgccgagcactgcggccccgacgaggggcgcggcgtgccgggatggcggtccatcacctcgggcgtgctggcctacggactctccgacacggagaacctccgtctccagaacgcactgctggaggcggacgtgctccgcgagatcgccgacaccttcactgccgacctggagtcaccctggttcaacggcgtacgggtcttctacggcggtgccccgggcgccgtggaggccgaggtccgggtcaacggcgaacgccacgaggccgcctccgccgcgctggccgcgctcggcctgcccgagccggccgtcttcaccgtcgcccggtccttcaccctggtgctgcccgtaggctccggccaggaggcgcacggccacggggccgacggctgcgggtgcgactgcggcggcaccttggacccggagcatcccggcttcgcccacgccctgccccacctgatcggcgaactctccccggccgagcaggcggagcgggtcaccgtcgacaccggcgcgatgatcgtcgcccgaggtgtcggcaacttcctcaaggtccggctgccgatccgcctcgacgacggccgcaccgtggtccacctggcctgggtgcgcctggccgccgaagtgatccaggactacacccgccgggtgcacgacggcaccttggagggacaccgcttcgagggcctgttcggcaacgccatcgagccgtggggcgaggagctgctccaggcacccgtcctcctcggcgggcagcgggaagaggcggacggctcgatccggcccagcgaggttctcgactccgagcacccactgctggcccggatcctgcacgagagctggccggccgcgttcgtgctcggcgaccgcgacccccggcggccgtcccgctcctgatcaccgccgggtgccccaccccgtacgccgtggcgacgtacacccgtcgtgcgcaggaggtggtgacgccgcagtgggcgcgtatacggccgccgcacgcgtcaccgcccgtgagcgggtacggcctcagtgggccggcgccggcctccggtccacgcgggccggacacctggtggtgccgcgcacggcaagcaggaacgcgacgatggggtccggtgcggccggatcctccgcgcgcaggatccggtagtcgtcgacttcgacgccgcggacgccgagctggtgctgcagcccttcctgaggcggttccactgtgccggccttcggccgatattgcagcgcgtaggcacctgcggcaatgacttcggcgagccggttggcgaaggacgcgttgcatcctccgagccggacgaagccgtggccggccacgggcccgtcgttgctcagggagggaagggtcagatctgcgagcgcgagcgccgcctgaaggttgctgactgcatcttgaccagcctggtaggcggtgtcctggcgccgcttgtactggattcgctctgcgtaggtcaattcgtacatgtcgctgatctctcatgatgggcgtgcaggctaggcgccggagcgcgttgtgtgttcggttcagcggagtgtggccctttgcccggcgcgcactggctctttgcgcaccaacctcgcggctgccaaagcgctgatcacctgggcagcagggctgcagcagatgccgtgggccgactcccgctgccgggcatggccgttccctacggcacgtcggtcggttgtgccgcagtgatcggacgcctggggtgcggggtccaggcggcaccgcggtggacgactcaggctcggctcgcgatgggggtgagagcgggtggaaccgtcggactgagtctggtgcggcccgtgactatcggtttcgatcttcgtttcaagagtgcaggtgaacaccccctttgacgtgtgggaaggaccgggttggccagggaggagtcagcagctgctaccgcctttgctcctcgcggtcgccacccgcgggttgatcggccctctcgcgtcgtcatgcgactgctcggttttcgcggggacacccgcccggcgactccgcccccaagctcggccggcgcatcgctctggccggtggcgaggccgtcggccggccggactcccctgacggtaccgactcgcgccccgtcctcctgtggtggcgcagtggttcccgccgggccgaaagaggatgaaaccagaggcagccccagcacggccggtgcgacatcgagcgttgttgcgacgtccatcgcccgttgcggcaaccggtacccatcgcccgggccaagggcctttgcgctgagcgcaggtggcactgccgcacgcgtacgaccgtcatgcgtcctatccgaatctttggctgtgggacggcgagtggactgtcctgctgccggccgcggggtagccgggagggacgctgcccgggccgcgtctggcggaggccgtctgccggagcgcggcggacacggaagccgtcgggttgcggtgccgcggagcggcctggcgaggcggtcgcgtgagcgtgatctggcggaccagctgttggaagcaggccagcgccgcgactgcgggaagagcagatgctgccccggcggcgatcgttctgggtgcctgggccacgcacaggagcgtggccagggtggagaacagcagaacgatggaccaggaatgaagcgcgcggcgctggtgcaaggcggatctgaggatggacagggaggcgaccgtccaggggccgtagatcagcaggggccaccagctgaccacttcacgggccgtgttgggtccggcgctgtggcgcagggtgtcgcagagggccagtccactgaggatgctcaccactgcggcgatgccgcccaccagcgcggcggtgaacagactgcccttttgcaccagggacacgaccggcgatttcggcaggttccgccggtgccccctggaggcttgagcgggcggcccgggagtggagttcttcagccctgcgatgaggccgatggtgctggtcgtggcaccggcacagtcgaagccgtctcgggtgaggggctcccgctgcccgtgcgcagcgctctcctggagtaggccggcgagttcctccgccggatcccatggtcgatgcgcctcgccgggtccgccgagcggttgcccaggagcggggggctgtacgtggtcgggccagccccagaacgccgaagtctccggctgggggcggacaccttggatgtccgggtacccgtacgactcatacacgggagctgccacccgggcactcgccgccggcggacgctgccgtgttccccaaccgcctgccgaagtcggtctggatcatgctcatcctatggaggaactcctcaaagatcgtcgacgagtcactcagatcgatttccagactctcgtgttccagcgtcgcgttccgggtcacgccgcagtcggccgagcccggaacaaaaagccacttcccaatccggatcgcaccggagcgagaactgtctccctgtccgtcttcttccgcggtcctgcggaagagggcggggagctttgctgttgtcatattccataaacgctgtcgatgttggtcagggtatgcgccatccgggtgatggtgcccgatgggcaagtattgggccctgtcttatcgatttcaacaaacagctgaaacgttgtttccggcgccgtgccaccccgcgaatcaggtaaacgacgagcctcggcccgatgcaggactccggtgcgcctcccggctgtcgagccccgtcggcggagtctctgtgcggaagggggcgagtgcgcctgtcggtattgagcccctcatcggctccgccggcgccgccgccccgggccggctgggccggctccaggtgtggagcgcggagggtcgaccgatcatcggtaaatagatcgagatgccaaggctggtgggttgccgcgcatggctgcaatcgggggacagggcgcaaccaggcatatgcccttgcgttatgccggtcgatcgccgggggtttggcccgggcggtccttgctcggctacgactttcgaaaggaccagctgtgggaggcatcctcctgtggatcgtgctgatttccacctcattgggcacagttttcactgcgttgagccccccgggggccggccgtctctggggcgtggacgccctcgagctgaggcgccaacgacgcttcaagcaggttctgtccctgcatgtagacgccatccggctgtcccgccgggaagccgcggtgccggtgtggccgggggaggggccggcggtcgtctccgcgccaggatcggtcatgagccatgtgggccacccgtcgtactgcgaaacgcccgcttgccggcggccggagccgcccgccgaacgactgcagccctgagggcggagtgctcgcgttggcggggcgcgtgatgccgcgcctcgggcgatgaggctccgggacgggggcacgctgaggccgccgaataggcgtcggcgagagcgcattcagtcctgccgactcgccgtcggtgcaccggtggaaagggtgtcagcgccctgaaaaaccccggcaattcgtacatcctcggagtggggtgaaaacccccggcaattcgtacatctgtgagcaggtgaaaaccccgggcaattcgcacattgttgttctcgcgccggtggcggccggtctggttcgcgcccggtgcattctgtcctgagagccgaggggaaagttgagagttttctgaaccgaaaaaattatcgtcggtctgccattgcgagggccgtcatctgtaaaagatggtgcgcttcgggaaggtccatccccccgagacgcgcggcaggtgaggaaacttcgttgcacggaccggattccggatcatctggacacagtctgcaagaagggttgcgtgagtatgcccccgtccggtgacccagcagctcgtgatccatggacgacggcacaacgggtggcgggcacggtgcgggcggtggtgatgcgggcgatccgccgcctggccgaagcaggaacggccggcgcaaccaccccgaccagcacacgaacgagcccgatgccagaacttcaggacgaatacaggtcgggctttgccctgcccccgcctccgccggcgagctcggcgagcgacctccgcgaatgtccatggtgccggtccctcgcggatcccgggacttctggcgggtccgcgcccactgagggctgtcagccatgacggagggggccgtcagccgacggagcggccgaggcggactggcgtcgtagtccaagacggtggcacggcagggcgcgctcttcctcccggctggtggttccggagcggacggtcctggcgcaggcgcaggcgcaggcacggtcaatgtcgggaacgagagcgtgggcgggcgagcggtcgagagagtgagcgcggtcaaggtcaccggcgtgggcctgggcgctgttcaggacgaggaggagctccgagacgaggccgagggccgcggcacgggcgcgggcgaacgccatcggggtcggtgatcttccgtattcccaggtcagtggccatgggcaagccctttcggaaaacgacgcccctttcccccgcgatagccgagggaaagaggcgtcgtccatcaggggctggccggggcgctcaggccggcagacccggcccggcagcatccagccgccgtgcccgccggccccggacagacgtcaccgcagcggtcgcggccgcggcttcggcgcgggccgcgggaagtcaatgccggcaggacggccggacgcggagcagctcggtccgcagcacgggtgtgccgtcgaccggtgcggggtcctccgcggtcggctcgattcctccggcggcggttttgtccagagtcgccaggccgtcggggccgaccgtgccgaacaccgtgtagttcgggcgcagtgcggagtcgccgtagacgacgaagaactgcgagccgttcgtgtccggaccggcgttggccatcgccagcaggccgcgcccgtacaggcggcgcgcgccggtcggatcggtcggtgcgggtggcagatccaccggcagctcgtccttgtacttgtacccgggccctccctcaccggtaccggtcgggtcgccgcactgcaggaccttcagcgtcggatacgccgtcagacggtggcacaccgttcggtcgtagaacccatgccgtgccaggtgcaggaaactctggaccgtgcacggcgccttggcctggtccaaacgcagcgggagcggaccctggctggtcggaacagccacgtcaaccatgccgcggctaggggtgcgccgcgggtcaggcggcagcggaacatgacgcgcgggcggctcgtccggggtctgtgcgtactggcaagggccgtgcgtggtgcgcggcggagcgccgtcggaagcggtggcggcacttcccccggacacaactaacgtcacggccgcaaatgcgctgatcagtgctcggttcatcttgtgcgccctcctgatgatcgccaggttttggagcggtcgcagtctagggcgtggtgtggtcggcgggaatggacaacgacaggaggccggcgaggggcgctggtcgaggaccgcggcggtcggacctggtggcggccgccgggcagcgccccgacggccctttccccgacggcggactcgccgtcggggacgccgagcagagccgccccgaagccgccgtccgggcggaggacgcccccgccctcgccgctcagtcgcgggccgagaccgagggcaccgcctggcggtcgatcagcacggcggggacccacgggggcaggcaggtcagcgggtggccgcgttgcgcagtgcgagggtggtgcgggcggcgtctgcgaggtcggttgaccgcaggcgtactccgacgaggttgacggcgtcgctccacgcgcagagtgtccggtcgccgtcggggccggccacgaggccgcagctgaggccgccgccgtgcttgcccgcgtcgaagggggtcacgtcgcgggcgttactggagtggaagaagccgcggagctcctgcgcgatcgatttggtcgccttgttctcggcgaccttggggtcccagtcggcgctgttgaccaggacgaagaggtcgtaggacccgtcggcgtcctggtcgtagtagccggtccgcatgctgtgcgggagtttccggccggccagcacttcggtctcggcgcgttgggcgtcctcgcccgtcaggaggcggaagcggtcgaagatctccgggaggatgatgacgagggactcctcggcgccgtccgcggagagcgcttcgacggcgcggggttcgggatggtaggaggcggcggccttcacgctcgcgacagccactatcaacacggtcacgcccccgatgaagccgttccgcctcctcttctcgcgcagggccagcgcggggtcgccgccgggcggggtggactgcgcgcgccaggagcggctcagccaccagagcagcgcgacggccgtggcggccgcggccatgactccgatgacctcgccgacggcgaaagcctgcgaggtggggtcgacagaagcgacgatcatgccccgcatcgtacgtgtgaccgaaaccccgcgggacaagccccggtccccgatcacgcgacgcagtacggtcggagccccgccgcaggagcccggctcaggcgccgctgcgccccggcccgcgggccggaagacgcggtgtggaagtgcgggacctgcatccataccgccccggccggcctcccccttctgccgaccggggcccgccccgacccgccaccccccaggcttgtccatggcgaacattggccccagcacgaacggttcgcagttcttcatcacggtcgcgccgaccacctgactgaacttcaagcgcacgatcttcggcgaagtcgccgacgaggactcgcgcaaggtcgtggactccgttgccgccaggtctttggccctgcgttccatcaggaccggcaggtaggtacgcacgcgcgcgtacctgagctcttcgtacgccgtctgtactgagctttgcgccagccccgcgtccatccgggagcgcgctttcatcagccgctcggtgacgtggcggatggcaacggcatcctccgattccgcgctacggcggcccgcccacggcgcagggcaatgggcgacaaactagcggtccgctatgaggcgaccgtcctcatggcggccatcggcgcatggctgtgaccagcacgcgtcaagcgcgttcagaacgagcccgcaggcggggaggtgctctcattccacgcagcattgaggaggatctgcgccagctcgcgcggctgggagaacatcggccaatggccggtgtccatcttggccagccgccagcgcttgctgctcagcagctcggccacatcttcgtctggctcggcgtcgtctggctcggcccccggcatcacgcacaggatgtaggtcgccggaagttcgccgagcggccccgccagcacagcgggctcggtcagcgtggcacccgggtgaggcgtcgagccacgcacgaggcgtgcgatctgctcatcggtgagaccctcgccgtcaaagtgagcagctggcgcgggcggccagaaccctccgttctcggcgatcgatgcctccactgccgccccgccgtccggccaggcggagacaaacgacgcgccgtcagttggaacacttgagtcgacgaataccacgtgggccagtcggtcaccgatccgctccgcggcctggcctaccgggatgcccgagtagctgtggcccaccaggactacgtcacgcagaccctggcgttctacctcggcaacgatgtcctggacgtgagtcgcttgccccgccggtacaccctgcttgtcggcaagaccggacagcgtcaacggacagacaccgtggccggccgcgcgcaggtacggcaccacgtcgtcccacgcccacgccccgagccgtgcacctgcaaccagcacgaaattcaccatgcccgcaccgtagccgggcagcctgacgatctcccagaaaatactttcgatacgcgcccgctgcagacatggcggcccgtgggcggaggcgggtgaaggctggctgatctcactgaaccctgaccgggccggccgccggggtcctgtgtcagcgcgcggtgactgaatacgcggcgagcgcgcggttgccgcgcggctcggcaatggcccggaggacgtcggcctggctcaggacgagctgtcgcaccggctcgggcagcatggccagacgctcatcgcttcccaccaggtcgaggcaggctgcgatttcccagtcgccgtcctgcagttcttcggtatcgaccggctggctgccgtcggccgtccagccggcctcaggcaggagccgcagcaggccctcacgggagaaaggtgtgcggacgttgccctggccgtgcgatcccgcggcttcggtctgcccctggatcagcacggcgagcaggtgcgccaactggtcgtcggaggcaggcgtcaggtcccactcggtgaaccacagtcgccgcgcccacggccgcacccggaccagcgtgtcgcgcagttgtcccagcgatgcgaagtaccaggagcaatgtgccagcaccacatggtcgaaggtgctttcgggaaagtcgactgacgggtcgaggacgtcggtgccgaagcggaagtcgatgcgtggcccgagagggcccgccgcgagccgggctgccgattctccgagcgtgaccggcgtcccataggaggggtcggccacgtcaacggccaccacgcgccccttgggcccaaccgcctctgcgaggacggcggtcatgtcgccctggccgcagcccagctcgaggacggttgagccgggtgtgatgtgccagctcgccacgagcgcggcgcggtgacgagtctgggccagctgggtatccgggctgtgatcggcggcggccatgccggccgcgagcgagggggccttggcgaggagatcggagtgattcacagagtccttggtgatttcgacgggtcggtgcgggccgagggtatgagacgcacgggcagcggcgccttcgatttcctggacatcaccggcacgacggcggcccaccctgtgggccggcagtgacctccgcctcgtggacgagaccctccgtgccctgaccgcgccgccctccgcgtcgcccgcgtccgcttcccggcggtgggtctccccgatggccggcccgctcccgctccacccccacccccgcccccggtcgaagccgccgtccccgcccaccgacagcaggccgcgcccaccaagggagcggggcgcgggcgctgacagggcgtccggccccggacgggagcggatggggggccgcgagctgcgcgagactccgggtgtcggggtggggtggcttcgggggggcgtcctgtggtgtgtgggtcccctcgcctcttgacccgtcatggcctgcaggtccggcggggccgcgcccccgcgccggccggggtttcgtccggccggcgcgggtgggggtgcgcggttggctgtccgtcaggggcagctgatgcgggtgtcgccggtgtcggtggtgcaggtgtcggagccggagccgccgttggcggtgtcgttggcgctcacgccgtcggtggtggtcaggcggtcgttgccgtagtagccggtgaggacgtcgttgccgcggtcgccgttcatggtgtcgtcaccgaagccgccgtcgaggttgtcgttgcccgggccgccgtagacggtgtcgttgccgaagcccgcacgcacggtgtcgttgccggagagcgcgcagatgacgtcgttgccgtagccaccggtgagggtgtcggtgccggacgtgccgacgatcgtgcagccccgggcgttgttgacggaggtggtggcggtggcgctgttgtcgccggtgttcgggtcctgcggggagccggtcacggacgcggtgtcccggagggtgccggtcgtgcgcggttcggcggtcacggtgaccgtggcgctcgcgccgggggccaggctgcccagggcgcaggtcgcgcccgtcgcggtggtggtgcaggtgccctgggagggcacggccgagatcagggtgccgccggccccggagagggagtcggtcagggagacgcccgtcgcggtcgccgtggaggaggccgcgttggtcacccggaccgtgtacgtcgcctggtcgccgatgctcaccgtcgtcgtaccggacttggtgaccgacaggtccgccgactgcggcgggggcgtggtgccgccaccaccgaggtagcgggccacgccgcggtcggcggcaaggctgttggcctggccgacgaccccgccggcgacgatcttcccgtcgggctgcagggccacttgggaggcctgctcggaggggccgccgaagtcggtcgtcagccggccgtcgccgtcgaaggaggtgtccgcggcgccgttggtgttgtaccgggccagcgcccagtcgcccgcgtaccggcccgcgacgacgatccggccgtcggactgcagggcgacgtccgcggcgtcggcgatgtccggtccgaaggtggtggtgacccggccggcgctgccgaacgtcgggtccacggcgcctgcggcggtgaatcgcgccagcccgaagacgttgtcatcgccggtcgcgacgacgatccggccgtcggactgcagggccacgccccgggccctggccccgaagccgggggtcgcccggccgtcgccgtcgaaggtggggtcgaggctgccgtcggtgttgtagcgggcgagcgtgacgccgccggggccggccccggcgacgacgacccggccgtcgggctggagggccaggtcggcggcagatgcgaaggttccgcccgggaaggtggtgacggccttgccgtcgccgtcgaaggccgggtccagggagccgttggcgttccagcggaccacgacccagctcgcgaggctctggccggccgccacgatgcggccgtcgggctgtacggccacggtcatggcggtctcgatcgcgtccgggtcgatgtcggtgaccgccctgccgccggtgccgaaggtcgtgtcgaggctgccgtcggggttgtagcgggcggccacccagtcgccgtaaccggcgatcgaggtggacccgccgaccgcgatgatcttgccgtcgggttgcagggccagggccctggcctcgtcgttgttgaggtcgaagtcggtgttgacgatgccgtcgccgccgaaggtcgtgtccaggctgccgtcggcgttgtagcgcaccagcacgaagtcgccgctggtctcgtcgaagtagccgtcgcccaccgtgatgatcttgccgtcgggctggacggccatgcccgagacgttctcgtagccggtcacgtccgtgacgaccttgccgtcgccgctgaaggcggggtccagatcgcccggagcggccgtggccgccgtgggcagtccgagtacgagcgccaaggcggcggcgccgacggcgccggagcgccaggcccggcgccgtggggagtgctggggcatgcgcgaaccacttccgtccgtcggttcctcgggtgccccagctttctgggacaccgggtcgggacggggccgcggcgggccggggctgcgcccactggaccgccgtgttccaccctcaggagtgacggaccgctcgccgacctcctccccgccacctggcttggttgccggtgaggtcgcgcatgtcaggagttcgcccggcgtgaaggacgaccgtgactgcgaggatcggtgtgcgacaggagaacgggacgcagaaaggggcaagcagctgctggcggagacttcctgatgaagcagcacaccttgtgcggtcgccgacgagctcggtgtgatcgagcggtcggtggcagcccgtcggcctggacagggtgctcctctcggcccgcccccaaaaaagcaactaaacgaaaacacccacctcggccgataaagtcgcagctcagaaaggtcgaccccgcgcctgcggggatggtccggtcaaggccccgcacggccgggacgagcaggcgtggatggtccgtccggtaccgcgatgctcaaggtgcggacgcggtcgaccctgagcccgcggggataggtccggttcacctgaggggcctgagggcccggcgtctggctggtcagcggggttgggggccttctgctgcgtttaggtggatcactgtgatgtctcggactgcggcgaccgcttcggggacgcccgccgccgcatctcccagaagaagcagctcagcctctccgccctcgccaaggagcctgaaccagtctgaccgacgactcggtactgtgctgtcatgaccggttctgccgagcgccccatactcttcctcgacgtcgacggtccactcatcccgttcggcgggacggggcagtatccgacccatcagaccgccctgggcaacatcgaacccctcgaagcgccctgaccgtttcgcgcccggtgacggcgggccccggggcgcccctccctcggtgggtaggcgcatggcggagctggacacgtcgaagggcggtcacttagacgtcgtctcgtttggctcggaactcacatgtctcgggctggaccgtacgcctcacgggtgcgctcgtcaggtcccgtggggaggtactccagcaggacgggtccggggcgcagggccgcgctgccccagccggccatctcttcgccggtcaggtagcggtacagccactcggcgaagtccatggcgtggccgacccagtcgccctccgagccttggaccacgattccgtcggaatgcccgtggacctctggagcgaggaagacagctgctccctggtccgtgctggcaagagggatgaggccgtcggaggaaccgagggtgatctgggaacggttgcagatcacccttggatcggcgtctggttccagatcgtcggactcccatgaccgccactcggaccagccttccgcatccgactggatctcctggcccaggttccgccaggcacaggccgggtgggacgaaaggtagaggctcccgttcagctggacgggggcgtacgcatcgacgatcgccttgtagtcggcgggaagtcctctgtcgatctcctgctccaggtgcagccaggcagcaggatcgttgtagcggttctccgctgggccgagcatggcgaagacggcctgcagatggtcggtcatggcggtcgtgtcccttgaagatggtggccgggaatggctggtgccagcatcgagtacccctcgtgtcgacggttggccggggttttcgttgtctcggcatggagatggtgcgacagctggttccagacagtttgtgggagctctttctccgggtgatgccggtagcgccgatgcgtccacaaggcggcggacgtcgcagggctgacgaccgtggagtcttggccgcgatccttttcgttgccacgtccggctgcacatggcggcagctcccacccatgttcggcgcttcctggcagaccgcccatcgccgcttcacgcactggaccgaagcccgggtttgggccaagctccaccgcatcatcctcgacgaactgggggccaccggggaactggactggtcgaggtgtgcgatcgactcggtgagcctgagggcagtaaaagggggccgctgacgggaccggatccgaccgaccgccggcaaactcggatcgaagatccacctgatcaccgaccggaatggactgcctctctcactgggcgtctcgggcgccaacatgcacgacagcctcggcctggagtcgctcgtgcgcgggattccaccgatccgatctcgccgtggaccccgccgacgacggcctgcgaaactgcacgcggacaagggatacgactacgtccgcttgcgccgatggctccgcaaacgcggcatccgccaccgcatcgctcgcaagggcatcgagtcctcgcaacggctcggccgccaccggtgggtagtcgagcgtactgtgtcctggcttgctgggtgccgccggcttcaccgccgctacgaacgcaaggccgaacacttccttgggttcgtcggcatagccgcgaccctcatctgtcaccgccgcctcaccaactgagacgtcgtctaagggaaggagcgcggtatgagagcgagaaggggtgccatctgtggttctccccggtgcggcctggtgaccccggccgccgggtggatgtatggctgggtcctctgcggatggtgcgcgtgttcagcggtcgtgggcatgtaggtcggtttggcgcggtggtcaattggtgaagctggcggtggccgtggtggcgtcggcgccgcctgcggcgtcggcccagttgttccaggtgccggtgttgtagtcgccgtcgcgttcgatgaggcggttgtcgccggtggtcgcgaagacgtggttgacgccgttcgctgcggcgctggtgacgcgcgtgaggttgtcgccgcccatgttgctccagccgttccaggctccaccgcggtcgaagtcgccgtcggtgttgtagtactggccggccgggctgatcgctccgaggtgcacggtgttcccgctcgcggaggcggtgacatcgagcgctttgaagccgccggtggggccggcgaggttccagttgccccacgcgccggcggcgtagtcggcgtcgagttggaggatctggcctgtggtgtcggtggcgaagacgtggttgacctggtcggcggtggtggcgctggtgacgtgcttgaggttggtgccgccctggtcgctccagccgttccactttccggccgtgtagtcgccgtcggtgttgtagaggtgtccgtccgtgccgatggccacgaggtggacggtgttgccgtaggaggacgcggacagtgcggtgtaggtcgtggagttgttgatggcgggtgtgaaccagcccgaccattttccggctgcgtagtcgccgtcgttctcgtagatcttgttgtcgctgccgatagcgaagacccggttcaccggtcccgtgccggtactggtgacctccttcagctgcgaggccccctgggcgctccagccgctccacctgcctgccgcgaagtcgccctcggtgttgaacaggtccccgttgggcgcgatccgctgcaaatgcaccgtgttcttgagccggggctgatccggccgggcggggccgccggtgaaccagtgtgccgaatacgcctcgtccagaggggtgaagaaggcctgggccagtcgggcgtatccggcgtcgttggggtgcagaccgtcggacatctgcgcgggatgggttgcgtccgcccggtcggtcggcgtcagtgcaggtgcgtcgacgaaacggaaacgctttccggcctgctgctccacctgttccagctgcttcagccgctggttgtaccgtgctgcgggctgggacaggtcctgatggttccatccgggggttgtcgggatgagaccttccatgatgacggcgactccgggacgggccgcgaagatctggtcgacgagggcggaggcctggtctgcggcctgccccgggtccgcaccctggttgagatcgttgattccgacgtggagcagtacgacgtcgggctgggctgccgccagccagcggttcgcgccggcacggatgcgctcgatggtatagcccgcgtgcccctcgtgcgcggagtccggcatcgcaccgtgctcaagggacccgacgaagtcgagcgagtagcgagactgcttggcggcgagcccgtgcagtggcaagcggtagcccgattcgttggaactgccctgcccgtaggtgatcgaatcaccgagaggcaggacgcggaccacgggtgccggcggtgcggcggacgcggccaccgcccccaggaccggggccgtggccgccaccaggaagacagtggcgctggtcaagatggcgaggcggtgcacggttctccttgtgaaagccgtcctgcccggcacgtagtcgtgccgggcaggacgggacgggacgcgggagcggtggtcggggcgcgccgcacggcgtcaccgacgctcacgtgcccgggcctcgcacctgcctgagaaggtgcgcggcccggacagcgggggttaggcgccgggggtggcgctgatctgcttgaagcctgcggcgtcgccgacgaggttgaaggggctccaggacccggcggcgtagtcgccgttcgcgttgtacacccggtcatccgagccgatcgcgtacaggtgcacggtcttgccagcaggggtggcagcgagctgcttgaacccggccgtgccactgaccacgctgtagccgctccacgtgccggcggagtagttgccgttgttgttgtagatccgatcgtccgaaccgatcgcgtacagcctgaccgtgccctcgctcgtcgccgtggcagcgacctgcttgaagccggccgtgttgccgaccaggttgtagccgctccacgcgccggtggagtagttgccgttgttgttgtaaatccggtcgtcggagccgatggcgtacagccggacggtgttgccggtcgcggcggcggtgatcttcttgaaccccgcagtgccgtccaccagctggaagccgctccagtcgctctgcccgtagtccccgtcgttgctgtatacgcggccgtcggagccgagggcgaagaggcggacggtgttgccggtcgccacgaccgagatctgctggaagccctgcgtgttgtcgacgagctggaagccggtccaggtgccggttttgtagttgccgcggtcttcgtagatacggtcgtccgcgccgatcgcgtagacgtggacctcgtcgcccacctggatcgaggtggtctgcttgaagccctgcgtgccgtcgacgctctggtacccgtcccacgtccctaccgagtagttcgcgttgttgccgtacacccggccgtccgaaccgatcccgtacaggtggaccgtcggggacaccgcaggagccgccggggtctgcggggtgccttcctcgccgctgcccagcggggagatgtaggcggtgatgacctggccgaacggggactggcctacgcgccagttggtggtcgtgttcgtgtggaccgcgttgctctcgttgccgcccgtgatggtgacgctgtcgccggaaatggcggtcacgatggcgacgtggtcgttgatgtaggtgccgtcgttcatgttgtagacgacagcatcgccgacgtgcggggtggtcgaccgggtgccgtacttgttcccgtagtcgaggaagctgttggccatgtcggtcagcgtgccccggccggcgaccccggcctgggcccacgcccagccggcgaagtccgcgcaccaggcgtgggtgcgccggccgttgctgcagctgctgttctggttcgggccgccgacgtatccaccgtgcgcgcagggcccgttcccggtctcgcccctggccgcggaggcgatggtctcgccgatcgtggcggcgctggcaggggccgctccgaggacgcccagcgcggcgaccgagatcgcggaagtgagcgcgaacgagacggagcggcgcagcgaagacgcagagacacggatggacttggacatggtggttcccccacagagtcgatcggtggcgctcggatcttccgtccggcgcttcgagatcaactctgtcccgggtccctgacctgcggaagtgtaatccgctggacggaaagggacttggcccaaaggggcccgggtgggctctcgggaccttccggagcaatagtcgcgggaggctccggggggaccgttgccactacctgttcccgaaccggatcgatgagccacgctgcttgaagccgggtcgccgcgcctgagaaccgccaacagaaggaggctgggcgaacctggttgtgcccgaggatttcgttcaccaccatgagccctgacattccctgaccgccgcgatttcgcagcgatccgtgtgctgttcaagccgcaccacttggtcgaagtcggtgcgggatccttcagaccggaccgcctgtccagcctggtcgcggcacgatgcaagcgcggccatccgctccggatggccgccggggaactcaccccacccaacgcagaccacagcctcctgccccaagccgccaccggccggcatccaggtggcgccacgcgtcccgaggaacactgccggccggtagatgatgcgccgtcaaacacctgttctcacgaccgcttgattgaacctcacccagccgcagggtcggtgttcgaggcgcgccgaagttctagatgatccgtgcacggcccgaaaggtcgatgcccacgctcgtatacccggcacgcaagagcagagccttcatccatccggcacggccaggacccgggacacgcgagaccgcgccctgtccacactgtggacccaagaggccatggcccgaacgggccacatcgcagcgcctgacatgcgagtcggccgttggaagagtcgacttcatgtacctcgtccacaccggactgcgcgcaccgcgcgacgcccgcgccgccatagacctgcccacactgatccgttcccgcctcggcccggacgacggagccgagcacatcagtgtccatccgcacgcccggccggatcccgtgatcggcctgtacctgcgcgcgcagtctcccggaggcggaggaacacgcgaccatcctgatccgccttctgctctcgcgctgccctgagctcgccgactggacgccactgaggccggaagtgccgctcatcgccgccgcgttcgaaaaccagccgcccatttccgagccttcgctggacggatcggtccaatgccgcttcgggccaccccaatccccttccaccccctctgaacagcgacgaaagtagttctcgccagcagggaccagctcccggcgggccaggaccggacagcgccaccgcgggacgcaggccggttgaggacacggacccatcgctcgaactgtcagaagagggcacccccatgctccgcacccgtatcgcccaggccgccgcggtcaccgccctttccgccctcaccgccctcggtgtcaacgccgccggccaggtcgacggaccgggccgcctggtcgccgccgctcccgccgccgagcaggccggaacctccgcggactccatgggctggtcgtaggaccgcagcgcccgtcagtcaaccctccgcacacacgccgaaccaccgaaccgaggtatccccatgtctgcaaccgtccgtccccgcacgaagatcgccgccctggccggcctgacccttgccggtctcaccctctccctggtgcccgccggtactgcgagcgccgcctccctcgccacctgggacaaggtcgcccactgcgagtcgacggacaactggagcaccaacacgggcaacggctactacggcggactccagatatacaagccgacgtgggacgcctacggcggccagcagtacgccgcatacccgcaccaggccaccaagcagcagcagatcctgatagccgagaagatcctcgcgggtcagggcgccggagcctggggcagctgcggagcagccgcgggtctcgccgacgaccacgccgacccctacccggacgtcccgcccaccggttcggtctccgcgacggtccacttgtacgggatcggttcggacggccgggtgtacggcaacaacgcgaactactcggtagggacgtgggacgggtaccagagcgtcgacggcacgcagggcttcaagcagaccacctcgatccaggtgggcgacgaggtccacgtctacgcgatcggcgcggacgaccgtatctacgaagaccgcggcaactacaaaaccggcacctggaccggcttccagctcgtcgacaacacgcagggcttccagcagatctcggtcgtggcgaccggcaacaccgtccgcctcttcgccctcggctccgacggccgcgtatacgggaagagcgccgactacacccagggcagcttcaccaccctccagctggtggacggcaccgcaggattcaagaagatcaccgccgccgcgaccggcaacaccgtccggctgtacgccatcggctccgacgaccggatttacaacaacaacggcaactactccaccggcgcgtggagcggctacaacctcgtcggcaacacggccggcttcaagcaggtcgctgccacggcgacgagcgagggcacggtcaggctgtacgcgatcggttcggacgatcggatctacaacaacaacggcaactactccgccggcacgtggagcggctacagcgtggtcagtggcacggccgggttcaagcagctcgctgccacccctgctggcaagaccgtgcacctgtacgcgatcggctcggatgaccgggtgtacaacgcgaacggcgactacgccgccgggtcctggagccccttcaacctcgtcggcgacgccgcaggcttcaagcagatcagcgccacccccggcgcctaaccctctgctcgggcccggccctgtgcctgtctgggctgggccgggccgtgccgccacggctgtgacggcggctgctcgccgccctcgcccaggtcacgccggacacggtccgggtcctgctcgccgaggcggccgggatggcgcgcgtggcggtggtcaactggcgccgccgcaacttgcagatgctcaggaggcgctgcgcggcggcgggacaccagtgaccggcggcggccgcctcggagtcggcgacgcggtgttcgaccgtgaccgccaggcgcgcggcgaggtcatcgacgccaggtcggctcgaccggcagtccgaccgcgctcgcggcgctgctgtcggtggtcggcccgggcccggaccggatcccgtttctcaccgtggtgtgcacctacgactccctggacaagatccgcgatgcccagcacaccggccgtccggtgtcgccgttcgatttggcgatcatggacgaggcgcaccggatcgcgggccgcggacaagaagtggacggtcatcaacgacggcgcggccatccacgcggaccgccgcctctacatgaccgcgaccccgcgcagctttgccgcccccgaggtgtcggagtccgcgagcctaatccgcccgcgccgccaccgtcccgccgccgcgctggccgacgcgtccgccaactcgatgaacaacgaggccgtctacggcaaaaagatcttcgaatatcccctggcgaccgccatcgcggacggtagagccgcggactaccggatcgtggtccccacgatcaccgacgccgacctccgcgccgtcctcaacctccccccacccggcaccgccggtaccccggccgcggacggaagcaccgcccatggcggggccggagaggccgcggcgcgcaccactgccctgcacctggccgtcctcaaggccatgacccagcacggcctgcgcagagtgctggtgtacttccacctcgtcgaggacgccacacgcttcacccgcgagctcggccacaccctgcgcctgctcagacggaacgcccccgacctgtgcccggacctcgacccggccctgttcttcgtccacggagaccacacccccgacgaacgggccgccaccttcgcagccttcgccgccgccgaccacgccatcctgacgaacgcgaagctcatctcggaaggcgtcgacatccccagcgtcgacgccgtcgtcttcgccgaccccacccgcagcgtcatccgctgcgtccaagccctcggccgcgccctgcgcctggacgtctccggcaaaaccgcctccctgatcgtccccgtctacctcccaccggacgccgaccccgaagacatcctcggcaccgcctacgagccggtgtgggcgatcaccacagcgctggcgagccacgaccaccgcatcgtggaacgcctcccggacaaagcgaaccggctccccaaagagacgagcaccctggtcgccaagcgctggcacttcgacttcaccctccaccccgaacgcatcgcccgcgccatggacctcatcgccttcaacccccacggcctcctgacccgctcacgccgcgcgggcctcgccgccgcacaggccttccacgacgactacggccacctcgacgtccccgccgacccgatcggcttcgaactgggcagcttcatcaacacgatgcgcgaagcccggacagccggccgcctcgacccgcagtggatcgccgaactcgacgcactcggcatgatctgggacaaacaccaggccgcctggcgcgcccgcctcaccgccgcagccgactaccaccacacccacggccacctcgcagccctcgccaccacccccatcggcgcctggctcgccgaacaacgctcccacgccgccaaggaccagctcgccccccagcgggccgccgacctggccgcactcgacccccactggcaactcccacacggccccgactggcaccgcaaataccaccaactgcgccaccacctcgaaaccggccgccccctcacccccgacaccaccaccggcagcatcaacctcggcggctgggccatccgccagctcacccactggaccaccctggccaccggccagcgccagctcctggaagccctcggcatcaccccgaccaccaccagcctggccccccgcccgacagcccgctgcaccttcccccagaccgtccagctcctcgaactcttccttcaccgagaacaccgcgccccaccgcccgcgaaaccatcaccgtcaacatcggcccctggttcgccaagacccgcaccaagatgcgcacaggccaactcgaccccgaacacgcccaactcgtcgcagcactcttcgacggcgactggaccgacgaagaccctgccccggccttcacctgaccctgccgccagcaatgtccggactgcacgaccccacgatgaacagaaaccccagcccaaagaggcacgacctccacatccagattcctggaaagttttgagggaaggaagcagcgatccgcaggggcgtaacggtaggccgatcgaagcagcgatctggcgtgaccatcacgctgacgcgaaggtccggtgctggtcccgggttaccgggcgcggcacggacgggaccccgcaggcgcacgtgacgcagctactcctcatcgaagtacaacggtgacagcctggcgccgcgctcggaagcatccacgtcaggtggtgtgatgtgggcgaggtcgccgtcgattgggatgtcgaattctcggccgatctcagcgatggcaactccaacccggccgcgcagcacacccagtgcctgaagtccccacatccattgcttccgatccagatccctaggtggggcgtctgggttacttattctctcaacgaatctgtgtgctgactcgacatcggtgagccactgcctcacggcggcgtgcatcgcgcgcacttgcttccgcagttcttctgactcgcactgctcgacctgttcgttcagatacgcacgcagttcctcgatggacccccaggtcccatctgcctcctcggtttcatacggcgcatagagcacccggtggtcttccaggcggagcaggatggacctcgcccgatcgcgctcacccagggggctgagctccacggtggcgccctgtccaaagaacgataggttgatcgtctgtagccgaccgcgcccgcgccatcgccattgcttgaacatcccaccgccagctgcttctggcgtacaggagagccagcattttcacacgcccacaggaaagccagacggtccgactggccgggtcgcaaaagtcagcctccgcccgggtgatacggctctccgcccgcgtccaccgctgcacggcgatccgaacgaacagtcgaagctgccgactacggttcccgcacgggactcactcagcgtgtgcgcttcacggaaagtgaaccagaccccatgtttcgacagcgccaaggcctgatcgttcccccgctgaccacggacacgggccggtaagagccccagccgtatagggccgcggcgtgcttctgggttacgggtgtacctgccaccagccagccgcctcagcgcgagtcgctttggcgtcgtactgactcgcgttgaagtggaattccggcggagggtagggcgcgggtgcgagcggggactccgacggaacctcccagtccgaccactgcacgatctcctcgaatcgctgcacgaccacggtcaggaagccgcagcagtcaccggtggtcccggttgccccagctccaggcggcgtgcctcgccggtcgcccggtaagggctggggcggccagccggcagggcatcagacgcgtacggcccgcggcccgcgtatggttcggatctgccgatcacttcctcgaccaagtcctcgccgttgacccagaaccgcacctgggcagcgaaccgggatccccgcggcaacaccttgatctccaaacgatcgaacatcagaccaccctacggcgtgcctgacatccggacttggcccagccgacgcctgcctccactcggccggcgggagggtccacgaggcgcctcccgcccctgtgaacatcaaccacggcccaggcggggcgcctcccgaagtcgtgcacaactacggccggaactcgtgaacagaaccaggtcatagaccgtgggcgacggggtgcagcggttcgtacagcgggagttcggctccgctgggaagccggatcgcagtcagtctgccccagcgctgctcgctgaccggacgggtgatctcgacaccctgcgcgcggaactcgccgagctgggcgtcaaggtcgtcgcacatgaggaagaactcgttctgcggtgggccgtcggtcgggtgcacggccacctcggccgggggcagcttgaagatgagccagccgtcgcccgcgtcgatgccgggaaagccgaggacgtcgcggaggaagacgcggtccgcctcggcgtcctgactgtagaggatgacatgtgcaccgctgatcatggctggctcctgcccgtcgacgtgcaagcggtcgtgcccccccggcatcctggcacgctcaggcccaagaagaccttcgactcgatccgatgacacgaccgccccttcgccgccagtcaacccgcggcagcgggcccagtcctgaatacctcttactcactgaggcacacctagcgtattcttgtccatttttgagccttccaagtcagccccgctcaatttggcgccacgcaagtcagctcctcgcagatcagcagtgctgaagtcgacgtcgcgcaggtcagcgccgcgcaggtcggcgccagagaggttggtgtgcgtgaggttggctttggctagctttaccccggtcagaatcccgtggttcagatccgcattagtcaggtcagcagcgctgaaatcagcgttgctgaaggtggtgtcgtgccggatcgctgcaccggacaagtcggcgtggccgaggtcggcgtgactgaggtttgagtaatagaaattcacatttgccaaattcgcgccgcgtagaattgcttcactcaggtcacatttggccaggtgtgaattttcccagtttactgctgcgagaatcgcatggtggaagtcgaaattggagagaagtaccccactcaggtcggagccgcccaggtctgcatagcggaaatttcgtttggtcaaaccggtgcctttgaaaagcggtagagagccatcattgaggcctgtaaggttgacaaatgtcagatgcggaatagatggcagtggctcgactgggcggttggccaggacggtgagtgctgccgcgacgtcggcgggcagcacagccgggtcctcaggcttttcgaaattccgtgggactttgtcacggatataggcggacaataccgaggtgaccgcaggttcatctcgcgccgagtcctgcatgatgcggccaagggcgtagatgccgccgatccggacgtgcagggacgatgctcccaagttgacgactgcgctgttgaaccggttggtgatctgcccctcttcggaaacacgcagttccttgctagcctgccctacttgcatccacgtgaagagtgccgccgctagcgccgccagccccggcaaggtcgaggccaccagcacccacctctgatgccggggcccactcgtctcctcgactgagcctgacccgtgaccaccgcgcgctgacctccctgccgtccgccgtcgtgcgatgacacgcaaccgctccagaccaaagttccgctgcacagacccatggcacatcacacggtccattcgtgaatcgcgccacgcggctcaaaccgcagccgaagagtgagcagccctgcaagcggcgtaaaccctccccaagcagctgctaccgccagccggctcgcaggagcgggctcaggtcctggaggcggctggcggctcccgaggtcagtgggttccttcgttgccgtcgtaggtggggccgggggtgctgccccatgtgccgtcctggggtccgccgcttgctccgatgacccagaagccggtcagtgagatgactgcgggtgccacggccagggctttgatccatttccccagggcgtcttggatgccttgggtagcagggctgagcatgatgacggcgacggcagcccatatcaccacgcatagtgtcgtgctgatgatcgtccatcgcttgatccggctcatggcgccccccactcgttcttcatcccatctgccggtccatcatgcaggcaccagcagaagaagccagcccgagccccgcttactgctgccagctggcccccggcagcgggcctggtcctggcggcggagccgtaaggacctgaaggggcgggagcgtcagcggacaccccttcgacgtccgcgcttgcgcggacatccggtggcgtgtcaacgccaccggcccggcgcttgcgccgggcctttccttgaacggccgcttgcgaaccgtcgattcccgggcttgcacaggcatctggcggagcgtcagtggagtctgtccggagtggagccgtaggggcgtcgctccgggcaggtcggcgctcaggggtccgacagggcgctcagcccagttcttgtgcctggcatgatctcgttatggctatcaccgtcgagtttttcgttgctccggatgatgtgacggcagccgggatgcgtccccggtatcgggatcacggtctcccggcggtcgtgttcgaggggttcttcccggatgaggctgtactggagtgggagagcctgtttaccggcgagccgatcgaccggatcgcgcagggggagccgcgaatggtggttcccacagcgaatgacggtttcggagtgttcgaggtgggcgcgggcctgcgggccctgctcgcgggggctggcacgctgcggttgggagggattgccgaggggtgggcggctctcgattcacgcgcggacgatgaggtctcgcgtgaggaggccgtggacatccttgaggcagttggggcgctcgcccgggaggcggtcagggctggacgaggcttgtactgctggtacttcgccccctgaatacggatgtgggatcgcgtcggaggagtccggctgcacggcggggtgcgcttgccaggcatgatgcaccgggaccggttgcgtcggtcgtctcggcttctccgtcctgctccgccctgatgggagacggctggagagaccaggcgtagccgcctaccgctgtctggactgggttgggacggggccggcgctggcaagcgtctgcttggccctttttccccggccgccggttgggccgtgaccacccccgcgcagaccgggaggtttatgccgttgggtttcctgtgctggaggcttcgccaccgaccccgtcgaagtggaccttagccgggccggcacgcggcagcggcacattcggaagggccaggggcgggagagagccagccccaccggagccggggccactgacaccgtcgccggcactcggcagaccaacccagccccctcaccgctgccagctggcccgcggcagcgggcccaggtcctgaaggcgaagccggaaggacgcgtactgggagcgccggcgggagaacctgatccgctccggctggctcgtccgccacctcgacaacgacggccggggccgccgcatggagatctaccccgtcgaccagagccacgtggattccaagtacagctggcccctgaacgaccgctccatcaccgtccggtacatctggcccgacctcgtccacgcctgggccgcccgtaacgaggcgatggtggacgagatctgggacgacgtcatcaccgacctcgactccgactacgccgcctacgcctacgtctcctccgtcggcatcggagcctgacccctcacctgacggaagtggctgaggccgctcgtacgcgacaggacggccgccaccggttcggcagcggccgtcctgttgttcgccctccgggcgcctcgacgaccgagtcgtcgcggatcggcatggggggttttgtcggccgaggaagcgtgggtcggccgtctgcatgtggtggccgaggagttcacggctttggaaggcggagtgcaggcgcagtgcaggcggacagccaggcgtgccggccgcccgcctcgctactgcgcgtcgcggaaatcgtagtagtccttgcccgcgacgaggaccgaggtgaaggagacgggcaggccgtgcggtccgcggggcacttcctgggaggtctggcgggtgaagcccagcgagacgcccgggaccacgatgttctccgggtcctcaatgtccacggtcgcgccgcgcccggtcagctccgcgaggatcgtgtcggcggggtccgcgaagacatcatgaccgtccaggaggacgcgcgtggtactccggcggccctcgccgggccaccacagctccacggccgtcacatggtcctccgcatcgaagaacaccgtgtagccgaccccgtcgacatcgcccatgagccggcgcgcgcgccgggaggtcgggccgacgacccggggctcgccccagggctgcagcgcggccaccgcctcttcgtacgtactgccgaggtgcacgggtccggcggcggtcggcggtgtcaggagcagatccatattgcttctccgattgtctacttgagcacttcgtagtctattgtccactcccgcttctcgagcatcttctggaacttcttgttcaccttgaggctctccaccatgtccgcaatgtgcgtgtcgtacttgtcgccgtacaactcccggatctcgtcgatgtccatcttcatcgcgaggtcccaccgaccggcgtcgatcagcgcacgctggtcggcccgccacttgatggactccgcgctcgatccggtgctcgtcaccccgcggtggtcgtcgtactccatccggatcgccgggcccatgccggcgccgccgccgtccttgttggtcttgaagccgggctcgtccaggtgcgcgtacgcattcttcgccggaatgtggttgacctccatattggtctccgtgcgccgcgtaccgtcctcgttcttcaggttggccgggctgagaccgctgtaccagccgccgtgctccgtacagcccttggcgatgaggccctcggggtcggaccagcggtagggattgaccacgaacgcgacggggttcgcggccgcgcccaggcccagcgggtcaggactggcgtagcgggccgtctgcgggtcgtagtgccggtggaggttgtagtacaagcccgtctcggcgtcgtcgtactgacccggcagccgcagcggcgtgtaggcggccgcgttgcggttccaggtcgtcgcgccccacacggtggaccgggcgtgccaggcgatccggccgtcctcgtccaccagctcgctcggcgcgcccgccaggtcggtgatgatcgcgaagaacctggcgtcgatgtcccggtcggctgccccttccacggctgccccctccacggccggcgcgctctgcggcgcgcgcagtcgccgttcccactgcgccagcgggcggtacccgtcgtactcccacgtggtgaccgtggagtgcgcggtgtcgacctgctcggcgagacgggtgccgtcccagacgaagtgcaccgagtgcacggcggtgcggtcgtcctgcgccatgcggtgcttggcggtccggcggcccagcgggtcgtagtcgtagcgccacaggaccccgtccggcgtccggcatgaggtcatgcggttctccgcgtcccaggtgtagcgccacgcctccttgcggcccgacagggtcgtccggtgccgcgccacggtgcgccccgccgcgtcgtactcgcaccggatgccccccgcgcccatcagccgcgtcccccgatacgtgcgctcgccgcgcccctcggcgcggtgcgcgcggtccggccagtcggccgcggtctggttgccggccaagtcgtacgcgtaggactcctgccagtccgccgcggtgacccgcagtgggcgaccgaccggatccatctcgaagttgagcgtcacaccaccgagttcatcggtgagccggtcgaggtggccgtccgcacggtagccgtaggagtgggaccgcagcgtccggtcgcccgcggtcaccttgcgggtggcgagccggcccgcggtgtcccaggtggaaccgatgacgagcggccggtcctccctcccgacgctgcgggtcagctcccggccccggccgtcccgttcgaagccgatgcggtggccgcccaccaggagcgcctcgcgccgccccgcagtgtcgtaggaggcccgggagacggtcccgcccggcgtggtgcgtgcaacgacccggcccgtggcgtcgtaggcgtagcgcatggtgcgcccgttcaccgtctccgcgaggatccggccgagctgatcgcgttcgacggtgacggagcagacggcggccccggcggcagatgcagacgaggatgccgaggccgacgtcgagagggcggacacgagctgtcccgacgtgtcgtaaccgaagcgggtcgacacgtcgcccacctgcttgcgcgtgacacggccgcaggcgtcgtactcactggtgagcacgtcaccggtcggggtcgtgacggagaccatcctccccgcaccgtcataggcgtagtcgaggccgcggccgtcgaagtcgctctcccgcgtcaggtttccggccgcgtcgtaggtgtagtcccaggtgagaccctgcgggttgcggacctggaccagtcgcagctcggtgtcgtgccggaactcgtagcgggcgccgtcggcaccggtccgcgcggtcagcaggtcgaacgggccgtactcgaagcgggtcgtgtcgcccgccgcgtccgtgcgcgaagtgcagttgccctcggcgtcccatgtccagctctccgcaccgccgtcgggcgcggtcgtacgcagcgcccacccctccgggctccattgcgtacgggtcaccgcaccctgggggtcggtgccttcgagggggcggccgaaggggtcccgtacgaccgagaaggtgttgccgagcgcgtcggtcagcgagagggcgaggccggcggcgtcgcgcgtgagccgttccaccgcgcccgacgggtcggtacggctgatcagcgcaccgttctcgtcgtggtggaagcgggccacggagccgtcgggagccacgacggccgtccggttgccgcgttcgtcgttctcctggcgccaggtggcgccgtcgggtccagtcagctccacgagcaggttcaggtcgtcgtaccgggcggtggaccgggtgccgtcggggaagtgcaggatggtgaggttgtcgttgtcgtcgtacgtgaagcgggcggtgtgccccagcgggtcggtccgtgccagcaggttgtcgtagccgtcccactcccgcagcaccgtgttcccgagcgggtcggtctcggcgacgacctggccgagggcgttgatgcggtgggtggtcacggcgccggtggagtccgcgaaccgcgtgatgcgcagctccgggtggcgcgggtcggtcgtgtacgagaaccgggacgagagcatgccgtccggtcccgtagtgcgtatgacgcggccagcggcgtcgtaggcgtaggagtacgccgctccgtggcggtcggtccacgaggtgatgcggcccgccgcgtcataggcgaagaccagaggggcgctgtcggcgtgggacacggtccgcaggttcccggtgtcgtcgtagccgaagacgtggagcgtccgaggcccgtcgggtgtgcgcagagcgtgcgaggtgaggcgtccggcggggtcggtggtgaactcgacctggtatccgccatcgtgggtggcggagagggggcggccgtccgcctcccggcggaagtgcacggcgttgccgttgcggtccgtgagggaggtcagccagtggcacgcgctgccgtggtacgggttgccggtgaaggagcgggtgaggccggagtggccgtcggagatcgcgtacgtcacgtcgccgaactcggtgcgctcgacgaggcgcagcgcgagccgggagcgggccgcggggaggacctcgtcgcgctcgtcacggggcaggcgcgggtagaagaccagcgagccgtcctcgcgggcccagacgctcccgcccgtgccgtccacgtcgatgtcgaggcgctcgtcgagggtggaggcccagccggggccgtagctgcgtccgtagtcgtaaccggatatgtgggtgcggcgcaggatcagcggcaggacgcccgggagggcgaggtcggtgtgcgcgagcaccatctgaccactgaccacgtccaccgggtcggtggcgcagcggcgcccgttgaggggtacacccttcccgcgcggatcgtccttgacgtcgcgtgtggaccgcgggtcccgggcggagggcgggctgtcgctgtcgccgccggagccgccttttccgttgccctttgcactcgcgtcgccggagccggagccattgcgtttcaggcggttgaagtcgtcgtggagggcctggtcgttcttcttgtggtcggtggagatctgcttgaccgctttgggaagggtggtgccgacgtggtcgcccatggctttggtggctttggtgagggcggtgagggccttgtcggcgacggggtcgatggcctgggcgatggagtcgcggccccgggtgcggccgtggtgggacttggccttggtgagtttggaggtggtcttgccgtggatgccggtgctgaccgtgttgaggtgagtgccggcgcggtcgtgttcggagtgctcgatgtgcaggtcgaccaggccggtaccgcccccgcctccgcccccgcctcctccggccgaggcgaggtggagggattccttgccggactggacgccttccttgaagccgtccttgcccgcgttcttcgcctggtcgaggtccacgccgtcctggaagccgagggccatcgagccgagttggacgacgaggtcggcggccatgccctccagggcggcgacggccggctcggtcatggccgagacgatgtagccgacggcctcctccatgcactccttgatgaggcgcttgatgacctcctgggtggcgcgcatggcacccgcgccgatcagcatcgacaggccgccggtgacgggtatgagggagagcgcgatgcccgcttcggtggccaggtagccgagttggaccagggcggcggacttcatggcgaccacggcgtcggcggccaggtccatggcgccggcgatggtgcgggccgcggaggcgaggtccttgaagtgcttgcccttgaccgtgttccagtgcttgttcagggcctcgatcgactcgcccttgctcgcggagagcaggcgttcgacgtggttgttcgcgagctggccgtcgtccaggaggtcctcggcgaactcccggagcgagtccgccatgtcccggtaggcgtcctcgtccacgttcggccaggccacaccgatcagatccagcagtgtgtccgcccaatcgggcaccgtgacagacacgcaacccccgccctccgtagccgaattcgctcaaacagtcgaacagtcctatcatgcgaccggcctgacgggtaatccgcattcgcaaaccgccggggtcggggttgaggcggacggcgcaggcgccgcgggtgggccggggacacagggggaggttggacatgtcgtcgtctggcgggtctgcttgatcagtacggcggtggcgcggtccaggagggcgttcagcgtggcgtgttcggcggaccgtgacgatccccgacgtgttggccctgttcaaggcctcgcgggtcggtggctggtacgagcactaccgagttcccgccgacccctgatgtcctgcgtaagcgctcgcagaggggtgcggacgagatctgggagggccgtcccaagtggcgccatcccgagatcctccaagcggctcagaagggagcggagttcgagaggtgcgccctggacatgaacgcggcgaacttgtcgacgttcaagtctggctccgatcggccagctccgcgagaccaccagcggcgtccacgatcggaagaagtccggcgtccgcctcatcacctcgacagcccggccggccgtgaggccttggccgggcagggcgtcacagcccgcacggtgcgttcctggatgcgcgggaaggccaccccgtccccggcgtccagggagcggattgacgcggcgtactggtggcgccggcgggagaacctgatccgctcccgctggctggtccgccaccccgacaacaacggccgcggcagccgcatggagatctaccccgtcgaccagagccacgtcgacgccaagtacgcccgccccctcagcgaccgctccatcaccgtccggtacatctggcccgacctggtcagcgcatgggccgcccgggacgaggcgatggtggacgagatctgggacgacgtcatcaccgacctcgactccgactatgccgcctacgcgtacgtctcgtccgtcggcatcggagcctgatcccctctcctgcctcggactgcgcgtgcgcggcgtgcggtgtcggaggagggactgcgcggcgggcgctggcattgaggtcaggtcggtcgaagacggcacctacttgggccaggacggcctgcgcgggcggggtctggttgccgccgaggtctcccggcagcaggagaacgccgactgggaggccgcccccgcgacggcaatccccgccgcgagagcagggggaggctgtcctcagcacccttctagtcgctgtacggcccgctgggcgccccgcagcgcgttgccgcccctcagtgagcctgttccatatcccggttttcgaggcgtccggggctctagcctgtagtggtgtccgagggttccgggcgtcccggagtgcgggtgtgtggaggctgcggtggccggttgaggccagccgcgcggccggacgcagtgttctgctcgacggcgtgtcgtgccaggtcatggcggcgggatcgtcggttgcggcgccgggtgatggcggagttgaacgggtcagggcgggtggcgtgtcccgagtgcgggacggtctgggtggccggggtggatcggcgttcggacgctgttttctgttcgcggcggtgcgtcatgagggcctggcggtcgcggaacgaatcgttcggagaacggtcacagtgacctctccacgaacgcatccgaatcggaccttcgatcagattccggctctttccagtcatccattgtgatcttcggcaggtgggttcgactctcggtcacgcagtgggccgcgtcttgtcacggccgaggggccgtgccccggcccgttcagggtggtgagaaccatgcccgagaagatcgagagtgccgacaaggtcggcagcgtcagcgcccaccgttacgagcagatcgtcgcggagctgcgcaagatcgtggaggcccagacccggggtcagttcgcgatcggggactacgccttggagatcgagcccatgcgagagcagggcccgcagggcaggggcgaggagttgttcacggtcaaggactcgctgttccgcctgtccgacatcgtgtgatggctcggggtacttcgccttaccggagcggacagcagcgcagagcggcgatcttggcccggttggcacacagtgaccccgagctcccgcagcaggacaccaccccggacgagtctccttgctcgtaccggggtggtctgcgaggggggcaacgccgggccttcgagcgtctccacccaaacccgcagagagggtgttcgtgggccggtggtgtggagtggtggaggccggtgcacggggtcgtgctcatgttgccgaaggccgtcgcctataagcacaacggccggcgcgtgaccgtggcgacccgggccgacgtcctcgttgtcgatctcggagaagcagatgggtggcgtctgctgcgcgatgtgtggatctccggtcagggtgtcgccgaggccgtgcagacgtgggaaccgggctggtcgccggtgaccttccgccgttggggccggggcggctggacggcgacgcggacaccggaagccgttcctgggtggcgcatcctggcctccgtgctcggcagtgaaacgcgcacgcgacactgtgcatagcgcaaaccggtgagggagatactccctcacaaaagaccgggactccgtttccccgtatggcccaaggagttacggggtctccatctgagttaacgctatgcgccgcagggtgcgctttttgcgtgccgataacagcccttgcgaaaaacctttgccccttgctaaaaggcccttacccggttttgcgcaaagcgcgaacaatggctttatgaatcgtacgaagagtgccgcccgcggcagccgccttcgggacgcccgcctcaggcggggttggaccgtgaaggaggcagcggagcgggcaggggtacctcccatgtcggtctacggggccgagtccgggaggcgcctgccgaccgcgcttaaccgcctcgccgaggtgtacagcatcacgaacagcgccgcgcccgcggagatgccagcgcggccaccagcagcacagggccgtcctcgcatgacggtccccgaggcgctggccaccgatgacgacgaatcagaggtcgtcaccgacttcgctaccggctacttcgcccgccgggaccaggagcagcggcaccgcgagcgggaggcgtcgtacctggcacagcaggaggagccggagcacggcccgcggaaggtggcccccatcggctacctcatcccggaaccacctccgccacctcctcctccgcagccgcgaccgcaggcgtaccagcgactcatccagccgaggtgaccatgaagtgcttcaaccccttgcgccggccgcggcacgcccttgccgagccgatcaccgacctctcgactcctgaggcccgcggcgactacgccgaggccctggcggccaaggaggccgactaccagtcgaggctggcgctggtggacttctcccggccgccttccccgccggtcgtccgtcgccgcggtgacggtgacccgccgccgactttcgccctggcgcggaaggcggcgcgacccgtaccgccgcgggcgtcgggcctgcccgatctggtggactgacgatgcgacgtacgcgtacgcgaggcgaccagcgacggaccatgctgcggggcggccctgtgttcatcgacgccgacctccccgtagaggaaccggagccggagcccgtacaagaagttgtgagccccgttcgggtgctggctgagcagaccctcgccaagcccccgccgagctgccccagggccccctaccgccccgaggggccgccgtcccggatggtctccccggtgccggtgctcaacggctgcggtactcccgtcgcttggacggacgagcaaccgtggcgcgagtgggagagccgtgtaggggccgcggcgtacgagctgcaacgcgaagacgagcgagaccggttgcgcgaggccgcggagggacgcgtggcacagccctggacgggctacgaggcacacgacccgctcgctaagacgaacgccgtcgtcaaccacctgcggaacagactcaccgcccagcagcgggcccagcgcggactcgtcaggccctggaacaggaccgcaccgccgaagaaggcggaagaggaactacccgaagcccagtgctccttcacccctgtcggctggtgggagtaacccgccggcccctgactttccgtacccaccgaaagagagccccaccatggcccgagcaagcctcggcgatccgctcgtacgcgacgagaccgcacagacccccgtcccgattcccacccccacgtggtactccgccagtgctgacggcgccgcggtacagcccccgctgcgtccggtacgcaagggcgatccgctcccgggcgggtacgccgccgagcgggagatccaactgttttggcgcatgccgcccggaaccgtcgacgggtcgatggcgccgggctccaagggcgtggatgtggtccaggttcgcggctatctcgttttcgtgggttcgctgccgatgccttcccccgggcccgcacccccaccccaacaccccccgccccggcccccgttcccgcaggccagtgccgtcctcccccgcccgttgtcgtaggctgcgcaagcgtgactaccggaaccggcggcatactcgccccacttgaaccccaggacccccgcgagaacgccggctaccggctgctcgcccggatcggcgaaggcggcatggggaccgtctacctctcgcacacgcgcggcggccagccggtggcactgaagctcatccgccgggagttcgggcaggaccccgacttccggcgccgtttcgagcaggaagtgcaggccgcccgccgggtgcagggctaccacctcgtcccggtcctcgaccacgacaccaccggcgccacgccctggctggcgtcggtgttcgtgccggggctgtcgctgcacgacgccgtgagcacctacggtccgctcccgctggacaccgtcttccagctggtcggctgcacggcgcgggcgctcgcctccatccacgcggcgggggtcgtgcaccgcgatctgaagcccgccaacctcctgctcggcgcggccggtccgtacgtcatcgacttcgggatcgccagggccgccgacagtacgcagctcacccggaccggcggggtcatcggcaccccgcagtacatgtcccccgaacacacgctgggcgccgaggtcaccaccgcgagcgacctgttcgcggtcgggctcatcgcggcggtcgcggccaccgggcggcacccgtacggggagggcggggccaccgccctcggtgtgcggatcgccaacaccgaccggctgcctccggacctgaacggctacccggcggagctgcggccgttgctggagcgctgcctgacggcggatccggcggagcggatcggtacggacgagctcgccgcgatgtgcgaactgttcgccgggcgaccgctgaacgatttcgacggctggctcccggagccggtcgggctggagatcgcccgacgggtgcgggccgcggagaacccgccggtgcccacggtcgcggacgcgggcgcgggtacgggccgcgcgggcgttggcgcgggcggatcgggtacgggcggtacgggcgctggtcccgccggcgccttcggcggggtgtacggggcgccgacggtgggcgcgccgccccggcccgcgggtcccccgccggccgccggccacccgacgcaccccccggtgccgggcccggcgcccgcgccggcccccggaccgaagcagttccggggcgtgctgatcggggccggcctcgtactggccgtcctcgcgggcgccggcgcggtccggctgctcgacggcggcggcgccgcgaaggacgacgcgaagcaggaggggccggtcgcgcccgcctcctccgaccaggcgcaggtccaggccccggctccggccccggtctcgtccgggcccaagaccgcgccctcggcctcctcctcgccgaagtccgcgtacacgccggtcttccaggacaagcccctgaccttgcgcgcgccctcctccagcaccgggacccacgtcgacctggacgccccgcagatcttcccgaaaggagccatcggcaagacccagggcatggagctcacctaccaggactggggcgacgccgatctgcgcttcctgacggccatgggcaagagcaccggcaccacgccggaggagtgccgggacgccgtcgccaccaacaccttggcctccagggtgggcaaggacgagctgaaggcgggcaagacgctcacgaaggggacggtgctgtgcaccgtcaccggtgacaacaacctggcgatgctccgcatcaccgaggtcgtgctcgacacgagcaaggggtccatcggccccatgccggactacgtcaccgcactcaccctctggaagatcggctgacgccgtgggccggggctcccggggaagccccggcccacggacgttgccctagacgccggcgccggccccggcccggcgccgcgacgcggcgaagcccagcgccacgtcggccgccaggaacaccagcaggctgatcccgagcagcggtacgaaccagcccacgagggccgtcgcggcggccagcggcactccgcaatttcccgcaatctcgttgaggacagagccgtgacctccgtagcgtcgaacgacaccgacgcgacgcactcagcacacggaggcggtgcccatgagcgcacccacacccgccggcctccaaccggaagaccagccgcacgccttcggccagccctccgcggcgctgatcgctcgcgccgatcgcggctacgcccgcttcctcgccgtccaggccccggccgccgacaccggcgaccacgaccaggacgacgacgcggcgggcgcccgatgagcagcacgcacctggtcctccacgaccccgaggggcacctcgacacggaactccccctcgaccgggagctccacaaggctctggtcaaggccgtgctcggatgtaccgggaaccccagccttccacccgcggacctccaacagatcgccctgctgctcaccggcaccgcccgcgccgtcgccgccgatgtccgccgcgccgccgacctgctgcccgaagaccacgccgcccgcgccctggccgacgtcgtcctcgaggaagcgagccgccgcctgtccgtcccgccggacggcaccgcccgctgcgcccagaaccgggcccggctcgtccgcgccctgtacgagcgcctggaccgcctcgcgggcgtcgcaccccaggccgccatggccccctgagaccaccgcgcacccgaccgggaccggatcccttcgggtgcgcggtgcacggcaccacccctggcccaacccgggccgggggagcaccactcgacaccgagaggggcaccaccgtgagcaccgcaaccaccgaactgggacggttcctgaccatcactggccagcgcttccacaccggccagtccgcacccgagatgttctccccggccgtcgacaaggcgtggcacgaactgctcggcacccccgcctacgaggccctgtgcctggagaccgccagccagccgatccgtcacgtcgcgaacaacggccacggcccgatcgcctgggtcgccgcctacgaggccgcgtacgggccgctgccgaagatctggttcaccgacgccgacggcaacctcgaccagggcgccatcgcccgctaccgggagaccggcaccgtggtcgcggagtgggactgcggccccgccggcggcggcgacggcgacgacgtcgcgcacgaccagccggagaccgccagccggtgaccaccggccgcaccatcgcagcgccccggcccaccgccggggcgctgcgcctcgttgaagccgccaccacccggccgagatccgtggacatcagcggctacgtacgccagatgaccgcccactgcccctacctccccccgtcgctccagcggggcctgacgacctggacggtctaccgcgccgacggcgacgccgacgccgtccaggcggagctcttccacgcgggcgcccaggccgcggagtggctgcggcccttgctgaaccggccgcacggcgccctgcggtgcgagaacatcgtcctgctgggcgacgtacccggtacccggcaccgtgacctgctcgcctggccgcactgggtgctgaaacacctctacggcccggtcggggtgatgttcggcaagttctacgcgggagaaggggaagtcaccgcggccggccaccggatcccggccgcccccgcctcgttcctccccgtgagggccgccgtccgtcgccgcgacccacgcttcctcgccgcgacccccgacctggccgccgtgctcgccgcggccgacgacgacggccgcgacgtgttcgagcacatccccaccgactggacggagatccgcacatgggccaggcgcctgatccccccggcaaagccgtcgccctcctcaccggccacaccggcgaacccaccgcgatccagctcctgagcgaccggcgcggctcccgggcctggaagatccagggccccagggcgccgtcgcgctgaaggccaacaaccccgacggcgacaacgcccgcgacaaggccgccgagatggcccaggaggacgaccacctccgccacctcaccgccgcgaacgccctgagccccgactaccgggtgcgcgccggcacctgggacggcggccggtggctggccgtcaactggatcgacggtgtacccctgtggcgcgccctcgccctcgcccgcggcccggaaggagaccgcgcctcggtccgcccctggctcgcgggcatcgcccgcacctggacggagcacctcgccctcatgcacgccgccggatgggcccatgccgacgtccagcccaccaacaccctcgtcacgcccggcggccacgccgcagtcatcgactacgccctcgcctgcggccccgacgacgtccaccgccgcgtcccgtaccgcggcgccctcacccacaccaccgcccccgaagtcgccaccgccgtcctcgcgaccccggccgacacacacgtccaggcgcagccggccgccgacatctggagcctgggcgcttccctgttctggtgctggaccggccaccgccccgtcgcttacgacgacgacctcgaccggctggacaagctcgccgtcatcgccaagggcaccaccaccacactgcgcgacgtccggccctggccgttccccgaattcgaaggcgccatcaccgcctgcctcgccccccgccccgccgaccgccccaccgcgaaggagctgaccgccgcatggtgaccctgcgcgccctgaccctcgacgacgcccccgccctcacccgtatctacagcggcgcctccatccggcacaccaccggcaagcccctcaccctcgaccaggcccacgagaaggtccgcgcagccctggcccgagccgccgaaaccccgcgggcccagtggagctggggcatcgtcaccgaggacgagctgatcggcctgatcgcgctgcggcgacgaacggcgtccatgggcaccatcagctacatcctccgcgaagacagctggggccacggctacgccacccacgccgccaaccacgtggtctccaccgccttcaccaccgccggcctcaaccgcctggaggtcatgcaccaccccgacaaccccgcctccggacgagtcctgatcaaagccgggttcacccatatcggtacgtctgactggcacaccgaagacggaaccactgtgccgtacgaggcgtacgcgctgcagaagatgtagggcaacccagcactctcgttctcgtctctgcaggcacccctaggcaccaccaggaggaaccagtgtcatacccgcatctgctcacccccgaggagaagctcgccgacgtgaagaagctgttgagtctcccgcgtatcgtcgtgatctgcggctccacccgctttatgaccgagatgaacgaggccgatctgcaggagaccaaagccggaaggatcgtcgtcaaaccaggcatcgacatgaagtcgccgcgcgcgctctggtcctctcctgcagaggcagaggcgctgaaggttcgactcgacgatctgcaccgggcgaagatccggctcgctgatgaggtgctcgttgtgaatgtgcgcccgagttcccccgcacgcggtgtccgtgggcacctccccagtggccctgcgttgtgcatcgataggtccctgtcacctctacgggtgaagagtgagggaacctcgtaatttgtgagctttcttctagcagcctgagattccctacgtttcgggaagttgagggggcgggatgtcgctcgcagtcgttgcaccaatccgatctcgaccgctgctgcagtcaccgcaagtcgtcgcggacttcgagcaggacctgctgtcggagtttgtgctcgcacgggcggcggccggactcgccgacgagacgatctccggcgacgtggacgccctgatggagatccgaggatggttcggcggcccgctctgggagctggttcccaccgacctcgaccgcttcttcggcgaggaccagcgccgactggccacgctgacgaaggtgcgcaaggcgcaggcgctggccacgtacttcgggttcctggaggtgcggcaccaggccgacatccacgctgccaccggagtgctggtgcagtgcccggtggacgagatcaaccgtccccgtggcaataccaacatgcgggtgcggatcccgccgccggccgcggacgtcgaccggctcttcgccggctggcgcgacgacctgcacgcggctcggaagtacgcgccgaccgtccgcaactacaccgcatgtcgcctggccagcctcatcggcccgcgggtctcggaactgtgtctgctcgaagttcacgacatccgctgggacttgggcaccttcggcaaggtactgctgcgcggtaagggcagtcgcggccagaagaaggagcgcctggtcccgctcatcaacggctcccgcgagctcctcgaatggtggctccagggaccgcggtgggagttcgacgaccagctcgatgagccaggcgcaccactgtttccgtccgagcgccgcgacaccggcgggcgctgcaagcgcgtgagcaccagcgcgatccggggcggcatggcggaggcagtgcagcatcacctcccccgctggaccggccgtgccaccccgcacgcgttgcggcacttcgccgcgtcggatctgtacgcgcaggggatgaacgtcgtcgccgtccaggagctgctcggccatcgctggatcaacaccacgatgatctacgtccacgtcaacaagacccacatcgaggatgcctggatttccgccggacagcggtggacgtcccggttcaccggttagccctggacaggagcccttatgaagtggaacctgcggctggccgccgcgcaacgcgacatctggaagtcatcgcagctgcaggcgatgctcgccgacgccggcctggtgatcagcgccgggaagatgtccaacctgtggtccgggcagccggtcacgatccgcctggacgacctcgacatcatctgcgaggtccttggctgcgaacccaacgacctcatggtccgagaaccggagaaggcccgcgctcagcgacctgcgagcactcccgcccgtgcggcggtcgcgggcgagcgccctaggctcgaacgcagggtcggccggacggaaccaccgctgtgagccacctgcgtccccgatcgtgcaagcagtgcggcgagaagatcgcggagtacggccgggcccgctgcttcagctgcctgcatcccaaccttccgcctccaaactgcaaggcctgcggcagcgacgcccactacgccggcggcttctgccgccgatgccatccccgcgtgccgtccccggacagctgcagcgactgccttgcctggggcctctggcgccgccacggccgctgcgcggcctgcacctccctacgcaaccgcggccaccagaccggcacctgcgcgacttgccgccgcaccgtgccgctcttcaaacaggggatgtgccgactgtgccgctgccaagctctcgcagttccgcgcacatggcagcgcccggactggtccaccgcggccaacaccgggcagcagctgttcctcgccgatctggtccggcgggtgcaccttgccgccgccgctcgaccgcaaggatacggagcccccgcggcgcaccagcagcccgacatcgccttctgggcgacaccccggtggcgccaggagccgctgttcatcgcagctcgggacatgtcgcgcgtcaccgtgaccgacgtcacgccgatcgattcagccttcaccgcctacgtcgccacacaggccgatgccagcgccgagacccaaggctggtcaccagccttgcgcgagcgcgtccagaagagcctgtacctactgaccgctgtgcacggtccgcacgagacgatcaaggccagcaccgttgcctcgctgccgcgtcagcaaaaccgacgtgccgtcatccgggtcaccgaagtccttgcccacctcgctctcctcgacgacgaccgcatcgaccccctcgacgcgtggatccaccgccgactggccagcgtgcacccggagatccgcgaagaagccctcgtgtggatccgcatcgtccgtcacggcggacctcgccgccgtccccgctcgactaccacggtccgaaaccaggccaactccgcgatcccgttccttcttgcctgctcgcagcgctaccgcaccctccgccaggtcagccgtgccgacgtcaccgagtggctcgcccaatgcgcggcaccgcacaccgaagccgtcgcgctgcgcgacatgttcaagaccctcaagagcgaacggctgttgttcgccaaccccgcacgcggcgtgagcctgggatcccggcccagctcggtgcccatgccgctgagccccgaaacgatccagcgtctgaccgcagccgccgaaaccaaccccgccctgaagctgctgatcgccctcgtcggcatccatgcgctctacccgcaccaggcccgagcgctgcccctgaccgccatcgacttcacccgcggctggctcacgctcggcgacatcgatcaccctctcgacgccttcacccagcaggccgccgtcgactacatccacctccggcaccagcgctggccacatacccgcaaccctcacctgttcatcagctcgcagaccgcgcacacccgcgccccggtcacgaccggctggatgcagcctctgctgcgcggcctcccggtcaccgcccagcaacttcgcgaggaccggatcctcgaagaggccgccgtcaccggcgctgacccgcagcacttatgcgcggtgttcaacatcactccggagaccggactccgctacacccgcttcttccaccccgaccccacggacagcgccgacgcatccggctgggtaactggataggtctgtggggtggtggtgatgagcgatcccgacgccgcggaccagcgcgacccgcgcgggacaggggaggattccagaacggacttcgttcaggggtggaccagcaggcccaccgtgccgaacgcgtaggaggagccgtagtgctcgtcgccccggaaggtagcgacgtagccattggtcagcgtgccggcgctggccgtgcccaggcggagggggccggtgcatgcggcctcgccctcggcgttggtgacgccccggcagatctcgctgccgtcgggcgtggtgaactccacgcgcttgccgaccaggggcttgcctgtctccgcgtcgtacagaaaggccctggcgccgatggacggcgggaagaggttggcgttcgcgttctcggcggaaatccgtgtcgcgtgcggttcgcgggggccgggctgaccgtgggccgaggcagcttgcgagcaggccaggactgcagtggcggcaaggaccgtggcgccgaaccaggatcgtacggacatgcagtctccattcaagaggtgtgatccggaagcagaatgatctgctccccatacgggtcgactaacggtgtggcggagcggaggttatggggtgatcggcctgcgaagcctggcatgcgccaatgccaactggacaaccgcgacggcgctgcagatcgaggcgtacctcgtcgggcccacggccgcgccgaaaacgcggagcgtcgtcggcacgtccggaccgccgggctgacgacggcgctcagccgttcagcgcccagcccgcactcacttctgggaacccagtaatggcaccggacccgcgacggccgcgacatttgccccgcctgctggatgaaagaacgacgatgatcgccaaccgacacgcgactcgcgcccaggttcggggcgccgagtgctcagtattcgcgaactcaggcgctttcgtcggcgactacatcggagacagcaccccagccgaaatcgcctacgcccggtcgctgggtaagcccgtgcggttcacgcaccccgaagtcgactccgacgcctgaccacccacccccacaccctccgcatgcacctcgctgcgcggtctggtcgcattcctggcgagcgaatcggtcgagtgccttgagtacatgggcgcgtgttgtgtcgctgcccagatggcctgcgttgccgacgatggtcagctcggcatcgggccaggcgcgggcgagttcccatgcggtgtcgagcgggccggccaggtcgagtctgccgtggaccagcacgcccgggatgccggccagccggtgtgcgtcgcgcaggagtgtgccttcttccagccaggcgccgtgggagaagtagtgggagcagatgcggaccagggccagttgcgcggtcggcgggcggtcgccgtaggggttggaggtgccgttcgtttccccggacaggactgcgtcctcccaggcgcaccagtcggctgtggccttctctcgtactgcggggtcgggatgttccatcaggcgggcgtaggccgcgacgatgtcaccgtcacgcggtgtgccgccagctcccgctaggaagcgttcccactgctcggggaagaaccggctcgccccgcggtagagccagtcgatctcggagcgccgggtggtggtgacggcggggatgacgatctgcgacacccgctccgggtacgtctcggcgtaggccaggatcagggtggagccccacgagccgccgtacagcagccagcggtcgatacccaggtgctcccgcagccgctccatgtcggcgatcaggtgctgggtggtgttgtgccgcatgtcggtcgtgggttcgctcgcgttgggggtgctgcggccacagccgcgctggtcgaacaggacgacccggtagcggtccgggtcgaagtactggcgtgccccggtcccgcatcctgatcctggaccgccgtggacgacgagtgcgggcttgccgtccgggttgccgcagacctcccagtacacgaggttgccgtcgccgacgtcgagcatccccttctcgtacggctcgaccggtgggtacagctcgctcatttttcggatctcctggcagctaaatgtggacaaggccttgtggtagacaacacggccgaggtgactccggcacctgcacgatcggcggggctgggctctcggccagtgcctactgacacgcctcatgtggctgaccactgacagctcgtgccgctagccactgacgttctggtgtcgtccgtcagaggaacgggccgcagccccggcaatccatatccccaagatccacagggacgcccctgtcatgaacggctcaggaacaggtactggcgaagtgtcggcgtcggagggctgacgcttcgaagggggggtagctggttctggtcgtgatggaagacgggtttgctgacagccagcagaggcggtgcggccgctggttcatccggtgcggcaggcgggccgactgcgggctcgaccgtgggccgggccgcggggggaggttcggcaggggcccggccgcggccggggcttgggggcgctcctctccggacgccgtggcgggctggcggggttgttacggacgagggccagacgatcctgttcttcaaagtcttcctccgcggttccaggccaggaagggaccgaggccgggacgagctgatcgagcgggccggcggaaatgcatcgtcgtcggtgtccaagcgcaccacccccgtggtggcgggcgagaaggccggctccaagcgaaccaaggccgaagaaccgggcatccgcatcctcggccccgaggaattcgccgtcctcgtcgccgacctcctccccaccacctagcttggttgtcggtgcggtcgcgcatgctaggagttcgcccggcgtgaagaaggaccgtgactcggggtatcggtatgcggcagagaacgggatggagaaaggggcaagtagctgctggggagacttcctgatgaagcagcacacctcgtgcggtcgccgacgagctcggtgtgattgagcggtcggtggcagcccgtcgacctggacagggtgttcctctcgccccgccctccccaaaaggcaactgaacgaaaacacccacctcggccgataaagtcgcagctcagaaagtgtcgaccccgcgcccgcggggatggtccgacgaacacctccgccgcgcccggggcgacgaggtgtcgaccccgcgcccgcagggatggtccggcgctacagatgaccacggatgcgctgcgtgggtcgaccccgcgcctgcggggatggtccgccgaccttccacgtttgccgttggagctcggcatccgctgcaccgcgtttgcgtgttgcggcccagtcggcttcgaggcgggaccggaagcgggttccggagtaggccgtggggaccgcgtcaatgggctcggtcatcgtggggctccttgtccttcggtgggagatgagccagagcacggcggagcagggtcggacgagccggggaactggcgcttggtcgggatgcgccagtttgccaccctggcacgcggcaggtgagcgggacggacgttgtcggcctcggtgcgagaccggctcaaggtcttcgggctggcacggctaagggacggccggggcggtgtggcgtcggccacggacaaacccacccgtcaaggggatggtcaaggaggaatcgggcactggtcgtcgttgacggtcagaccgcggacaaggggtgcttcctcacggtgaccccggcccgtacgcacatccgcgtacgggccggacgctcacctacccggcccgcaggccgggagaaaccgaggacaccgtgcccgccgacctcacacccgaccccgctcgcgagcaccaggccgcccgtgaccgccggccttccgatgacgtcgaccaggtaccgcaggccccctccacgggcccctccatcgccccctccacggccacttcgcccgccggagacgtatccgcaggtcagccccgcaagtcaaggggccgcgacgcgttcgacaaccctcctaggtcgacacaggtctggaagccgaccggagtgcgacgcaaggaagtgctgaaggctctggggatcttccagcgggctaccgccgatcagctctggcggatgctgcgcccctccgataggcatgaccggatgaccagggacaccctgaacgcgttgaagggctcgggcctggtccgggtggagacgcgactggagtccggacaccagctgtgggtgctcaccgagaagggccacaaggaagccaagctgctgctgccgaagaacgtacggatgtccgcgctgcgcaagctggagttcgacgacgaaggccggccggtggaagccgacgggtacgacgaacacgccgccgccgtcacctcgaccgccgccgtgctcaccggggccgggtacggcaccccgctgtcctggcagacggagatcgcttatcgcctgccgtacgggtacacccagtacgccgacctgacgatgcgcgccccggacgccggggtgcccgcgatgctcctggaggtcgatcgcgtcaccgagcccgtcgatgacctggtcgacaagctgcgtcggtacagcgactggttcgagctcctggcgccgaaggccgacgcgaacaaggagcgggcggcacggggcgcggcggtgcatgacttccggctgtggtcgcggatctacccgccgaccggccgcgaggggtacgtgccggtggcgttcgtgttcaccgggaagacggcggcacagcgggagagccggatgcggcggctggagcaggccgcccgcacgtatttcgccggcgcttcgtacccaggccgtagcgcgggtatcacggccgtcgactaccaccgggcggtgcccgtggtcgtcgccgagctggagcggatcaccgccgacccggccggggccgctggtgcggtgtggaggcggctcgggcgcgaggagtggcagaccctgcccgaggccctggacaaccctgacggcgaccgcctgtacgccgcgcagtggaaggaggcccgcgaccggcgggcggagcgggaggcggcggagcgggaggcggcggagcgggaggcgaagcggccggtgtgcgcgcggtgcggggcgaagttctccgacgaacgctggcagcaggtgcggcagtcctcgtggcccgggaaatgggacgacctgtgcggggagtgtgcgaaggagtccgtcgcccgcgcggaggccgagcgggcggcgcagcgcctggccgaggacgtcgcggcgacggcggctgaaccggagacattgagggcccggggtctgttcaggcgtcgcgggtagctgcgcgacctcggggagtctgggcaagccgccctttcgaggacggcttgcccagcaggagacggctgggctcaggagccgagcgcgggagggttgctgtggtggcgcagccggagccacaaggggtgttcggcgagggcgtcgagcaggatcgcggccaccgaccggtcgacggtccgggtgcgcttgacctcgtcgatcacgaagggcgtttcccaagcccatagttcgcgggcggccgtgttcatccgccggccgacgatgcccagagccgtgagggccggcttgccggtcagctccggggagatgtactccgcgatgacttggccccggacaccgggcgggcccggctgcgcgcacacccgccacaccacgtccagctcctccaccgtgtgcagcgacctcacccaggcccgcagcatctcctccgtccaggccgcgcgcacggtagggatcgcgtcctcgtacgaatcggtctcggtgtcgatcgtgaacctcaacgcccacccccaagctcagcgtcttgtgcccggaggctacccggcgcgcaccgccgcaacggggcgttctgggggagtgggcaagcccaaggggactctgggcaagccgcctcggccggtggcttgcccaccccggccggagcacgccgggcggggcggcgtcggtcacggccccgccgcgcagttgcccggtgaggccgcggctgaccgatggccggtgatcggtcggcgggggagttgcatggatcggtcacggggcctgacgtgcggtttgaccgatggaccgaggagatcggtcacgcccgcccgggttaccgatctgtccggcgggcaagcccaaggggaccctgggtaagccaccccccggacggcggcttgcccaccccgcccggggtgggctgagctggccaagccgcgccggacagcaaggcccgaccggaggaggacacggtgcgcggtttcgagacgggccagacggtcgtacggcgtgatgtgcaccggtcgggccgggtgtggagcgagcaggcactgcgggtcgtctgcgacaccggcgaggcgctggtgaccgcctgcgcgcccggagcgcaggcccggtggcccgccctgtatgcgcaggcccgcgcggagggggaccggtcggtgcgcacggcggcgttcgatgcgatggcggacggccggtgggagctcgcgggcgcggtgtggcaggagaccgacctgctgctgtggaagccgcccacggcctggttcagcatcaacgctttcttcgtgcccgacggggacgggcgccggctgcggaactggtacgtcaacttcgagcaccccacccgccgcaccgcggctgggttcgacaccctcgacctcaccgtggacctggtggtcacgcccgacctcgccagctgggagtggaaggacgaggacgagtacgcgcacgtgcgccgtctcgggatcgtctccgacaccgagcaccgggccgtcgaagccgcccgcggtgaagtcctggcgatgctcgccgaactctccggggttttcgcgcaggcggagcggtgggcggcttggaggtgggagccggcctggcccacgccgtgcctaccccggcctacggcagccgcggagagggttgcaccggaagggggctgaacggttgcctggagggttgctttcagcgggggaccgcaggtgtgaccgggagtgggagcccggcaaatcggacactgcccattgttcctggtcagccccactgggcaagcctgtccgcgccgatgacacctctaattcgttagtaattagaggttctggatctctggtgggcccggggcggcgtgttcagcccggggcaggacgtgtgtggtccggtcggtgccgtggtgacccctacgacacctccgaccgtgcgaggtctgtagaaagaccggtggcgctgggtgccggccggtcctcgcacgttctgcccccacgggcccgtcgggttcgggaaccttgacggatgagctgccgtacggtgacgcgttactcctcacgagcttcgagctctggacacggcgtgcgcccgtgcggtccggcggtgccgcgcacggctgatgaggtggcggaccttggagtcctggaattagtgcgccgtgcggcccgtgtgctcgccgtcaacaacagcaccggcgaaggggcggggaatggacgtgttctgcgggatcgactgggcggagggacaccacgacgtcgcgatcatcgacaacaccggcaagcagctggccaagtgccggatcgatgacgacctggacggctaccagctcctgctcgacctcctggccgagcatggcgacagcgccgagacgccgatcccgatcgcgatcgagaccagtcgcggcctgctggtcgccaccctgaggaccggcacccggcaggtgtttgcggtcaacccgatggcagcatcccgctaccgcgaccgccacggcgtgagccgcaagaagtccgaccccggcgacgccctggtcctggcgaacatcatccgcaccgacatgcacatgcaccgaccgctgcccgcggacagcgacctcgcccaggccatcggcgtcctcgcccgcgcccaccaggacgcgatctggaaccggcagcagctcgccaaccagctccgctcgctgctgcgcgagtactaccccgcggcgatcgaagcctggcgggacaaggccggcgcactgacccggccggatgcccggaaggtcctcgcggcggctcccacccccacccaggccgccgagctgcccgcgtggaagctccggctgatgctgaccaacgccggccgcaaacgcggtatcaccgaggacgccgaacggctccacacgctctttcgacagcccgccggccgtcagcccgccgcggtcgaggaggccatgggcctccaggccaaggccctgctcacgcagctcaatgccgcctgcaaggccgtcgacgagctcgccaaggcggtggagcggaccttccgcacccaccccgacgcgccgatcatgctgagcttccccggcgtcggtcccggcgtcggcgcccggctcttggccgagatcggtgacgaccgcacccagttcgccaccgccggcggactgaaggcatacgcgggcgcggcccccatcacgcgggcctccggcaaacgcaaatacgtcggccgcaggttcgtgaaaaacaaccggctcaaccacgccggctacctgtgggctttcgccaccctcagccactcacccggcgccaacgcccactaccggcgccgacgcgaggccggagactggcatgcccaagccctgcggcacctgttcaaccgcatgctcggccaactccaccactgcctccagaaccgggtgaccttcgacgcatccatcgcgtttcctcctcccaccgcagctggctgatcactgagggctcggctcatgacaggctgtcctcctgagcactgagggggagccatggcagaagtcggcggatggatctgggaacgcaacctgcggtcgttcctggagttgctgtcgcactacgtgggctacggcttcgacgccaccgactgggagacggtggcactggcgatcgaggcgaccgacgacgagcggaccgacggctggtactcgtaccccttggtcggcgagcaccgcgaggtcgagattcggcttgcccgcgcggtcggcggcgatgaggtcaggctggccgtgaatggggctctgacgcccgaactggaagtccgagcggacaccttgctggccgcttttgcagctggctgaccaaggtcaacttgacccgttagccgcatgaggtgtctttcctacgcgatagccgaagggaagaggccatgtcccagcccggggcggccggagagcgccttgcccgccgtcaccgccgggcggaaagatcggcacgacactgacgtcacgaccgagggggaagtacacggtgagcaacaagctgctggcgccggacggatggctcgtgctggggctgccctggccggagcagacccaggacggctggggcgagtgcgcggtggccatcgccccgacgatgatcccccgcgacctcgtcagcaagagcgccggcatcgcgctcgacctcgcgacgggcctggcccgcgacccgaaggacgggcccggcaaagcggttttcttttccgacgtcaccctctggctcgacaagcagggcaaggactgggccgacttcggcgccgactacgaaaccgtcatcgacgaactcgtgggggcaccggtcccccagctctacatgacgctcgtgcagaaggcccacgccatcctgtgcgacgctagccgcgacggggtgcgcctgtactacccgggcggcgacgtcgaacacgtcaccccgcaggtccgcgccgacgtccacgccgccatcaccaccagcctggaacgggactggccgccctacatccagggcctcatcgaccgcggcgccttccagacccgctagccgggccgcacacgcgacgggcccggcctccatccagggcgggcccgccggccatcgcggccctcgctgtcggtggcggctgggaggctggtcggatgaacgctgatgacgagcagctgctgcgcggccgggtgtacggccacgatcacgacgaccccaacccgggcccgctgccgcaccacacgtacgccgtcctggtcggcgggccgttggacggactgctgcttgacatcacgggccggcggccggaggagatcgaggacggcgtcgccctgatgaccgagttggggcggtggcccggcggccgggcgctgtacgacccatttcgtcggtgatgtcaccggggcggagtgcgctcatccccccaccgtggacgactgcccccgctgaaggccacatctccagagcgcagacctgggacgtgcggcggcgatagcgccagctgcagcggctgctggagatgacgggggcgctggggctgttcacgatgcgcgacggccagacaccgacagccgcctcctgagacggagactggccttcaggccggggtcagtcgtcatgggcctgtgccgtggatgcccggggccgcgcgggggtcaggtgtggatgcggctgttggggccctcttggtcgtcggcggtgtcgtcgttgaaccagtagtcgccggcggcgaggtagcggaaggagtgggtgctgtccttggggagttcgacggtgacggcccggttgccgtccttgcgcggggtgagggcgtgaacgccggggcgccagccgttgaagtcgccgaccacgctgacctcggccgcgggggtgtcggcgggcaggacgaaggtgaccttggcggagttcttgcgcagggcgcgttccagcacggcagggctccagacgagggtgaggcggctcaacggacccatgctcgacggcgggcatgagctgggcccgctgacgtcgccgtaccagtcgccgggtcacccacccgccacacccggcacgacccaggcacccccgcgtgtgacagtccagatgggaagaccgaatcacgggttgtcccacgcaagcagggcccggccgcccggtagccacaccggtcgggccctgcgccacacagcccagacacacagacgactctgcgcggggcctgcgccttcacgtcggccttggtcgccagcgcctcaacagtctggccgagctcctcgtgggtgtgctcgacctgctcgcgcagctcttcggaggtaggcgcacatccatcgccctggggctgatcgtatcttcggggcagtaccccgccgctcccgttgcaggccgacttactgcagtagtttcagggctgcagtcgccagtctttgggcagtgaggtgttgttcgtcggccggcaggatgagatggctgatggtcatgcggacgatgacgtccgcggccatttgcagagactctgtgtgctgttgtgggtatcgcgtggccagccagccctggacgagggtttgaccggcgtcgaagatcgggtccgctcgggcggtgaggtagggcaggaggctgtcggagccctttcgggcggctgtgatgacggcttttatgaggggctgattgtcggcctcctgaagtacgtacaggatggccgcccggaggcaggcatgggaatcgggcgcgccgggatagagggtgtcggccacacccgccagaaactgctgggtttcacggactaccagcgcacggcccaggccggcgcggttgccgaactccttgtacaccgaggggcgcgacacttcggcacgggcggcgacggccgagaggctgacctggtcccagccggcttcgcaggtgaggtcgcgagcggcgtccaatacgcgctgcctcatctgtttgcgccaggcgacgcgcggggggtcgggtaccgacccacctgtgagtgccgccgcttcgatccggtgccttgccgccgccatagtggccagtctgtcaggggccgaagcccgtccggcgagccgggctcgtgagtgcgggtccggcgggcgcgcggtggtgccgacccttggagaggggtcggggccggcaccacgtcttggcgccccaagtgatccgaagggatcaggagcgcttgcgtcgcgccgcgaagaggaggccgccgccgatggcgaggaccactgccgcgatgcccagcggcagggcagggttggagccgcctgtctctgcgagcggaccgcttgcgctttgcggcttcagcccggagtcgccatcggtgccgtcgccggcttgcacgcccggtgaggcggcggggtcacttccggcggactgaccgcttccggcgggggcgtccccttgccggccgggggaggaggcgtcggaagcatttcccgggctactgctgttcttggcgccgaagccgtaggcgccccggtcgggcgtgccaacggcccggcgggctccggtgaagtcggtggtgacggcggcgaacggcgtacccgagccggcggcgggggagccctcgctcagccggaagtccgcgtcggctccggtgcccgtcttggcgaacttcggatcggcgatgacatcgttcgggccctggacctcgggggccttgccgccgaagtagatgttgtagtcgtaggtgacgtccacgttgcgggacttgctgttcgtcgcttgccccggccggccgtacgcgatgttgttatgcagccgcacgtcggtactgtcgtgcgcgaagatgttggcgtagctgtccatgcgggtgctgcgcccgttggcgtaggccgtgttgtggacgatgtcgacgtgctggctcttgtaggagtggatgccggagccgccgttgtcgtaggagaggttgttggcgaccagtacgcgtccgttgtaggcggggtgatcggcgtcgcccttgagggtgtcgatgatgatgccgttgccgtcggagtagcagccgcacttctcccatttgatcttggtctcgttgtcgtggacgcgattgccggtgatgcggatcttgtacgtcccggcgtcgccgcccccgacgtcgcgtggggtgaggacggagatgccgctggttgcgtacaccgcgtaccaggaggtcccatgcacgtggttgccggagatggtcacgtggtcggagtcgatggccgatatgccgccgccggcgcaaccgtgcacctcattaccggccacctcgacgtggtgcgacagcgcacccgtggcccggtcctgttccagggagatgcagttggtgttgtaggtggggtcgcccttcttcgattctcgttcggctccggccagggtgagggctccgttgttgcccttgacctctaggtttttgatggagatgtaggaggcgccggagacgctgatgccgttccacgccttcaccgggtggatcaccggatggtggccgggatgagcggtgaaggtaatgggggctccggggaggccggagcgcttgatggtcagcacgttcgaccccgccgagcgctcggagtacgtgccgttcatgatcgagacggtgtcgcccggctcgacgctgtccgcggccttctggagggttcggaagggagcttgggtggacgtgcccgagttgctgtcgttgccgctggggctgacgaagtacgtgcgcgctgcggcgtgcgcagtaccggctcccatggtggcgaggccgagcggggcggatgaagcgagcagtgctgcggtcagggcgagggtgctcgtgcgtttcactgttgcctggtctcccagtttgtcctggtgaagcggctggtgccctccgtgggccgtggccgcgagcagagagcacgcaaagggaggcgtttcgtccgtatcgccgcgctggggcacggcgccgggcggtgaagccggggggcgttgcgctccgaagtccgctgtgaggggggtgagttactcgagtgacagttccagactcgaaaattgaacgcaaccccggactatgtgtaaacgttctgacagtacgtcatgtcattgctctgtctggctgacgctgcggaggaccgcagggtgcccggcctgccctctgccaggggtgccgggcccggcttgtggagtcacagcagaggccggctcacccgggagcctgactcagcagggctctctggccgcacccacgcgccctacatgccctgttcgggggaggcttccggtaggccacggagagccggtagggaggccatccccgagtggttctgactccgcccttcgagccgatgctcgcccaggccgccgagtacgttccgggctccggcgtcctggcgagcggcttcgcggcggagcagaagttcgacggccaccgcgcaattctcttcacccccgcgacttcgggcggccggctgctcctgcagacccggcgcggttccctggtccaggaccgattccccgatctggtcgcggccgctgggcagctgccggagggtctggtcctcgatggcgagctcgtcgtctgggacacggcagccggccggcccgcagtgctgcgcgcagcggggagaacgggtccggggcgcggccggtggacgcttggcgctggcgtagggcaggggcggcgctagagcgtgtctctttgatgggttggtcagttgatcggatgtgtctgtccgattagtgatcactgatgcgatgtggggccggatcgagccgctgatgccggccgatccggtccgcggccggcggtgggccgaccaccgccgcacccttgaggccatcgcttggaagtaccgcacgagctcgccctggcgggacctgcccgacgagctcgggtcgttccagaccgctcacaaacgactgctcagatgggccgtcgacggcacttgggagaaaatcctcgcctccgtcctggcagcggcggacgccgacgacgacatcgactggaccgtgtcagtggactccacggtcgtccgggcccaccagcacgcggccggcgcacgcaaaagggggcggcccgctccggcgagccctccgatcacgcgctcggacgctcacgcggcgggctgagcaccaaggttcacctggccgcggacggtggggcacggccgctggcattcaccgtcaccgcaggccaggccggtgacgcacccgccttcgagacggtgatggcccgcatccgggtgccccgcacaggcacgggcaggccgcggacccgccccttcgtcgttctggccgaccgggcctactcctcccgagccatccgcagccacctgcgacgccggggcatccgcgcggtcatcccgcagccgtccgaccagatcggccaccgcctgcggcgaggccaccgaggcggccgcccgcctggctttgaccgagaggtctacaagcagcggaacacggtcgaacgctgcatcaaccggctcaagcagtggcgcggcctggccacacgaaccgacaagctcgccatcgcctaccaggccgcactccacctcgccggcatcctcatctggacccgacgctgaccaaagagacagaacctagtcgtaggcgccggacgagtgcgctgccggggcggcgcatgatcggttcttcggtgaacgtgttccgccgccggagtgaggcgtcctccacccggtcgaatcggcggggggcggccctgtatcaccggggccatgatcatggcccgctggtctcgccgggcgggaagcggcgttcacggtccggcagggcagtcacgagggtatttaagccctttacttggctatttaccgtcataaaccgctccagcttgatcacccttcgtagcgtcatatgtgggtccgggtcacgcgcgtcccggggcctgccgatctgagaggactgtcatggagtctggggcaacgaccgcggaagagcggttggagcggtggcagggtctgctgtcgggttcgcgaagcgattcgcggacggcacggaatctggcgcgggtgccgaaggcgaacgtgttgttcggggtgctgctgcatggtgcggaccggttgcggcagggcgaggaactcaccgatctggagcacgtgctgttgggcgtgctgcgggagtcgctgggggatgaggaggtcggggagtggggccgcgtctaccgcgagtcggtgtcggctcgcggggcggcgctgacgggggtgcccggggtcatcacgggccgttcggtctccgaggggtacggcttcgcggacttggccgaggacatgccggcggtgacggcggagtggtcggcgcagtcgaactggtcggcggtcgcccccgagtcgctggcggcgggggaggctttcgacagcccggagttcaccgaggggatgcgcgagtggggatgggctgtgaccgtccccgccgatctgaccgcgcagagcgccggcgacgagccgcaggagccgcaggaaaacgatgagcgggcgggcctgtaccgcgtcaggctggactacgagaacttccacgtgcaccgcgaggtgggtgacgggtggccgggcaccagggacgagatccgctggatctccggaggccagagcgacaccaggcagcacgccgtgccgtacctgtcgcaggagttcggcggtcaccagacggacagggggcagacaccggcgttcaccggccatcggacggctttccatggtgatgctcggctcgggctggtcctgagcgtcgcgtgctgggagtgggacaccggcgacggcaacgacgacagcttccgggaagtcatgaaccggctgaacgagaatctgctcttcaacctcatctgggatgccatcggcacgttgtcgcccgacctcatcggatacctgatggacctcacgtccatggcgatcaccatcaccaacctgatcgcgaggaatgacctctccgcggcccgctcgctctacctcgaccagaaggccctggccgcgctctcccacaccggcagcgcgcagtggcacttcgccggtgacggccaccacgaactgaaggtgaggttcaccggagacaagatccccttccccgccaacgacctgcagtgcgtcatccgcaccgacaccacgtggagcgcgccgaccaccctgcccttccagggtctgagcggccccaccctggccgtccacgacaacaagctgtacctcttctacatccgcaccaacgaccaggccgtcatgtgggccagcatggacaccagcggcaactggaccacccccgcccgggtctccaccgaccgcagctggcacgcccccggcgtgacctcggccaacggaaggctgtactacgccgtcaccgggatggacaacaaggtctacacccggaccttcgcctccggaacctggcgcggccacgacgtcaggcccggctccgcgctgcacagccccgccctggccgccctcggggggcagccctggatggtcgtctgcggtctcgacgaccgcctctatctcgcccggcacaacggcaccgcctggaatgcatggtccgaggacaacctcgactggagggtggacacccacgtcgccctggccccgcacggcaaccagctgtgtcggatcgccaccggcaaggaccaacggatctacaccagcgtcagcaccaacagcggctgggtgaacggcggcatcgcctcccccaactggcgcgcctcccacgctcccgccctcgcggccaacaccgccgccaacaccctggcgatcctcatgcgcggcacggacggcgcactctgggcgggtgagttcagcggttcctggcacagcgcccacagggtccccggggccgcggccaaggaagcagccgccgccgcgtacttcaacaacaagccctacgtgatgtacgtggacaggccggggcccgggctggcgatctgaacgaaggcgcgccggatcgggacggcccgcccgcggcgcttggactggtccagcagcatccgtatggtggcgtcccgagatacgggcttgtgccgctggagcacggagagttcggtggtcacgggcaccactatggaggccgtagtgccgacgctgtgacccgattacacgggtcgcggccccgtgcgtgaaccgctcagacggcgaagaatgatctcctgtgaacgatacgaccccagtaggaaacatccccagaaacgtcgccgcaggccggtgccattatgtgtgcccgaatccataacatttcagaagttgatctatggctgtctgggaccggtctcttgaccgatttcggatgtgactccgtgctcgacggctgaggcgcctccgaacactgtgccggtacgaggggcttgcgaggacgtggacgcgccgccgggccggcctggtgctcgccgcggccatccgccggtcgctgcgtcgcgcactgccggcgaggtccgtgctgcacgctcatgggggacggagcacgctctcctccggccccgcagacaccgagccccctgtaggcaggacatgaccccttcgcacaccaccgacgagcagcttctcgctgccctcacggccctgggcatcgacgtccccgacgacctgggccacagcagccacgaccccgaactgcgcacggccgctctgtgggccctgctctggcgctccgcaggcgtcggctacgaggaatccgttgccggccccggccacgcacgcgcctacttcaccggcccctgggagtggcccctggccgaggaccaggtccggcgtgcctggttcgaactcggcttcgccggtgaccggctggactccctcaccatgacggtgccgccctggtcggtcggacttccccacgaggacgctcccgacgaccccaccgtcgcgaccgacggatgggcgtacgccgcgagcaccgctgtcggcctcgcacaggctcttctcggtccacttcggtggatgtcgtcccagcgtgccccggccgccatctcccaggccgactgcatgctacgtcgcctccaggccaccctcgaggaactcggtgacgccaccgcacacccccggtgcgagaactgcgacggcctccaacacacaactgccactgtccccgagtgcctcgactgttcagtctccgaatcagccaccaagacggagggtgccgagtagacggcggcaacccacgacagagatgctccgcgccggttgcccccaggcaaccgcagcgtgcatgccgtacttccggttgcccataggaaaccgggccgacgagccccagctgccgactcacctgaacgagctcggcggcctgcacatcggtgccgagggccgttcgtcgttcggccgccactggcaacgtctgctgagtgagcgtggttcattcttgacctacggtcgacagacgtggtggcgtagggcaccgtgacaggacctcgcatgacccgcccgaccgtcgaggtgctgcgcctgctgctgtcggcgccgccgcacgagccgctgtgggccacgggaatcggcgagcagaccggcctggactccgccgcatccgcttccacgacctccgccactcgaccgccaccctgctcctggaacgcgtcgacctcgtcgtgatcaaggaactcctcggccacgcccacataggcgtcaccgccggcgtctacgcccacgtccgactcggcctccaacgccaagccatcgacagtctgacgggtgctctcaacgcagcccctggcactgccttcgagccgcccgccgcaccaactgtccgctgacgttgccgtcagcgttgccgtcaagcggccagatgccctcccgaagggtccgggagggcatctggttgtttattgctcgacccccttcacaagacgcctggcagtatgccgtgtccgttgattagcccaatcggccgtggacaatccccgaagtaggaccaattggtctcctgggatagccctctcagacatccagcagactgcacgctctgcccagtgactgctccgacttctgatcgccattgtcagcacgtcatcgactgggaccaggctctcaagcccgtccggtgacagcttgaaccgttcagcagcagacgccaagcctgctcgcagcgacgactcatctgcgtccagaatcgtcacccaagacgagggaagaccttccgccgaggattcgactacaccatcgagtcggcctagcgtccacactcccttcctgtcgagccccagccaaatgccggtctcgctgattttcgtcagcggcagccacatgacggcgccggcttcattcgcgtgggcagagaagatccagcaggtctcaggcacggctgagagctctgccatcaaatcattttccgtcacgacacctgccttaagaactggatgcaccaggaacgtcatcctgctcaccaatgcatgctcggagtgtggctcacggttataccgtgttggcccatgaagtcctggaatgccttccttgccgaatcgtcccaggcacgggcgcgggcgcgcccgcaggagcgggggcaggtgccggagcggaaatcggtcgggcgggcgcagcccacgggtcaccggccgcgcccatgcgttcggccagcacgtccctcctgccggagcgcgaagccggcctcctgatcggctcacgcccctggccgctgctcgccgcccgcatgcagcagctcggcgaacaccacggcaccgacaccgtcgcccagcacctgaaccgtctcaccaccggtacctcctggcaggaggccaccggcagcgccctggtcggccgcctcgtcgacgccacctcatgtccctgaccaccccacccggcgcaccggcccccgcccggccccgggcctccgcggccgccgcccgctcccgctccaccaccaccccggccgccgcggcccccggccggccggccccggcggaggccgcggtccccgcccaccggcaccaggccgggcggaggtcctgcccggggtcaccgtcctcgggatggaggtcgggaagtggctggtccggcagcggagacgaacatgtcggttccggttggtcgttgaggtcaggcggcattccggtgatcggggttcgcgttctgtgttgctgactgcctctcccggtaccgtcgggcattgtcggcgatgagtcgcgccaggccacgctgcagagcgggccggatgagctcaatggccgcgccgagggtcaggcagccgccggcaagcattccccagaaggccaggtctccgaggccctccgtttcaggatccccgtagtaccgagtccccccgaggaacccgcagacaacgattgcggcgcctaggagcaggagccaccaccacaaacctcggcgacttcgctccttgcgctgcctgtctaccatcccgatcagcccctcgttcgatgatccactcatagatccccgggacactacctggccgcccctgtcccgcagaccggccgtatcaccaacccttcaccccggctcgggcaagaccagcgactccgccctcgcttccggcctgctccaagccctgggcaaaccggcccgcctcccggagatcacgctcgccgccctgcgccgggcgcgcgccgacgaaccggacttcccgcccccgatgcagcgagtcagcacgcacctctaccgcgtcggcgacctcaagaagtgggcgcgcaacctgccccgcgccgcccccggcaccaccagcctcgactgatccaccaggcagagcggcagggcggcagtccgaccgcttcgtcgaccgtaggaacttggcggtatgcggtatgcggtagctggctgcggctgcggagagaccgggcgattagggcagaccgaaaatccgcgtcgcttgtcggacctggttgccagactggtcggatgaacgagggatcatcagcccagtggctggcgcgggcgcagcagatcgatgaccggatcgaggaactccgtcccgaggccgatcgtcacgtggtcggtcagcacgtgatttcccaagtgcttctcaagcgcttcgccactccgttcggcagtaacgggcttaagcttttgcccttcaaccttgaccaccccaatcgtgtgcacaagaaggcgagcccgcgcgagtgcggcaaggtcaagcacttcgcacgcttcgcttctgcctctctggaacaggtatggggcaggcttgagacacgaatacccgacgccgcagccgcagtggatcggggcgacgtcttccaacacgaacagtatgtgcagaccctcaaggacctcatcgccctgcacctggtccgttcgctgaactaccgcgatgtccacgagcgcatcttcaccaagatctacaccgagcagcgcactgccctgctgaccgaccaatccgacctgctgcgtctcgcggtactgcagcgcagcggactccacctcgctggaccgcagggcttggtcgcagcggcggacgagatcctgcgcccacacttggcgaacttcgagaacggcgcggacttccgggcgcggatcgaggacaccttcgccaaggcgaaggagatgatcagcggcgccgggctggagattctggtgcccgccgtcggcgagtttctccttggcgacatcccggctctggcgatccggcagagtggaagcagaaccgtcttcaacgttgcgatcggcgactccaccgccatcgtgttgcccttcggccccaaacatctcctggtcggcagagcgccccgcaacggtatgggcatcgctacggaagaggcggtcggcttcctcaaccggcttcagatcgaagcagcgcagcagcgcgtctacatccgacccaacagcggccaagaggccttcgttcgcagctacctcaaacagggcggccggagtgccaggagataaaggctgaccccgggctggtcacaccacgggccccggggtcgacgatgccgtgtccgatggcggttgctgctccgctgaggagatggacgccagcctcgtcccgaaggcgcgcaaggccagcagcggccgccggtacaccggcgccgcgtacgagcagcctgtgcatctgcgtcagcccccgccggggccaaggccaaggactgagctgacccccgcgggtgctggggaccttgacccccgctccgtcggtgtccgccgacgcgagcgggtatcgctgtggcttgccgccgttcgggtggacgcggccctcacctccctgaccaccctgcccgccgcaccggcagtttcccggcctcgggtccttccgacagcggccgggtcccgctcacccaccactcccgcggcccgcggctcccggtcagctggctccggccgtgggtggctgcggtcccgtccaccgggagcaggaccgcatcgacctctacgccgagctcgccggccccgtacgcggctatccgacccagccgtagccgcgccagtccttggcggatacgggcgcgcgacggacctgaactcaccctggacgatgccgtcactgcctacgcgcgactgggtgcccgggcagggcgagtactgacatgtctcggacggtaagcggtcgagaaaaccttgttgccggaacggccctctgcccaggtcggagccgatccaggacgaccagccccggaacggtcccgggccgaaccagccgcaccgcaaccggtggtcgggcggatgagtcctcggcggcatgagcacccagcccccggccgcaggttccagcccaagtgccacgacacaacggcgcccagcgtcccgggagagcgcgaagtcgctgctcgtgggtctattggtgaggcgatcactggtgatgggaaccagcagatgtgatccggccccaccgccaggccgttaccgggcgcggctgctaccgccctcggcgacctccaggaccgttgccgccgcccacggcccgcgtccgcttcccggctgtgggtctccccgatggcggcccgttcccgctgcggcccccggcgggccggccccggtcgaagccgccgtccctgcccaccggtagcgggtcgcccatgccagggacgcgggatgcggccggtgagcaggccgtacgatccccgggggacgaggcaccgacggagttcggtcacgggagggggacggacatgaggttcttctcagtggagggccgggagtacgtcgctctcacagtgctcgggagcgacgacttcgacgctctggaagtggtggagatgactgcggctgggcgtggcgcccttttgcttgagttccggatggatgaggagaccgccacgctggtccacctcggcgcggacgtaggtattccgcttctcagggcctccttggagatcttccgcacggacttcctggagccgaggcgcgcagcggggctgccgctgccgcgctggtagccgagtccggcctacgcctggcgttccggttgccggagggagggtgcggtcgcggcggtgatgacggcccggccacgctgatgccggggactggccagccatactccggtagcgctagcgcgaggagcacccacccctcctactgcgcccagtcgacaccggcctcggcgagggcggcgagctgcgcctggtcgagcttgtcgcggcgggccttctggttgccgatccagatgccggtgcggtgctccgttccgtcgggc

SEQ ID NO: 2 - DNA, 20182 bp, Streptomyces sp.
  source 1..20182: mol_type = genomic DNA
tgggtatcgcgtggccaagacagcccccggcctggacgagggtttgaccgcgtcgaagatcgggtccgctcgggcggtgaggtagggcaggaggctgtcggagccctttcgggcggctgtgatgacggcttttatgaggggctgattgtcggcctccctgaagtacgtacaggatggccgcccggaggcaggcatgggaatcgggcgcgccgggatagagggtgtcggccacacccgcccagaaactgctgggtttcacggactaccagcgcacggcccaggccggcgcggttgccgaactccttgtacaccgaggggcgcgacacttcggcacgggcggcgacggccgagaggctgacctggtcccagccggcttcgcaggtgaggtcgcgagcggcgtccaatacgcgctgcctcatctgtttgcgccaggcgacgcgcggggggtcgggtaccgacccacctgtgagtgccgccgcttcgatccggtgccttgccgccgccatagtggccagtctgtcaggggccgaagcccgtccggcgagccgggctcgtgagtgcgggtccggcgggcgcgcggtggtgccgacccttggagaggggtcggggccggcaccacgtcttggcgccccaagtgatccgaagggatcaggagcgcttgcgtcgcgccgcgaagaggaggccgccgccgatggcgaggaccactgccgcgatgcccagcggcagggcagggttggagccgcctgtctctgcgagcggaccgcttgcgctttgcggcttcagcccggagtcgccatcggtgccgtcgccggcttgcacgcccggtgaggcggcggggtcacttccggcggactgaccgcttccggcgggggcgtccccttgccggccgggggaggaggcgtcggaagcatttcccgggctactgctgttcttggcgccgaagccgtaggcgccccggtcgggcgtgccaacggcccggcgggctccggtgaagtcggtggtgacggcggcgaacggcgtacccgagccggcggcgggggagccctcgctcagccggaagtccgcgtcggctccggtgcccgtcttggcgaacttcggatcggcgatgacatcgttcgggccctggacctcgggggccttgccgccgaagtagatgttgtagtcgtaggtgacgtccacgttgcgggacttgctgttcgtcgcttgccccggccggccgtacgcgatgttgttatgcagccgcacgtcggtactgtcgtgcgcgaagatgttggcgtagctgtccatgcgggtgctgcgcccgttggcgtaggccgtgttgtggacgatgtcgacgtgctggctcttgtaggagtggatgccggagccgccgttgtcgtaggagaggttgttggcgaccagtacgcgtccgttgtaggcggggtgatcggcgtcgcccttgagggtgtcgatgatgatgccgttgccgtcggagtagcagccgcacttctcccatttgatcttggtctcgttgtcgtggacgcgattgccggtgatgcggatcttgtacgtcccggcgtcgccgcccccgacgtcgcgtggggtgaggacggagatgccgctggttgcgtacaccgcgtaccaggaggtcccatgcacgtggttgccggagatggtcacgtggtcggagtcgatggccgatatgccgccgccggcgcaaccgtgcacctcattaccggccacctcgacgtggtgcgacagcgcacccgtggcccggtcctgttccagggagatgcagttggtgttgtaggtggggtcgcccttcttcgattctcgttcggctccggccagggtgagggctccgttgttgcccttgacctctaggtttttgatggagatgtaggaggcgccggagacgctgatgccgttccacgccttcaccgggtggatcaccggatggtggccgggatgagcggtgaaggtaatgggggctccggggaggccggagcgcttgatggtcagcacgttcgaccccgccgagcgctcggagtacgtgccgttcatgatcgagacggtgtcgcccggctcgacgctgtccgcggccttctggagggttcggaagggagcttgggtggacgtgcccgagttgctgtcgttgccgctggggctgacgaagtacgtgcgcgctgcggcgtgcgcagtaccggctcccatggtggcgaggccgagcggggcggatgaagcgagcagtgctgcggtcagggcgagggtgctcgtgcgtttcactgttgcctggtctcccagtttgtcctggtgaagcggctggtgccctccgtgggccgtggccgcgagcagagagcacgcaaagggaggcgtttcgtccgtatcgccgcgctggggcacggcgccgggcggtgaagccggggggcgttgcgctccgaagtccgctgtgaggggggtgagttactcgagtgacagttccagactcgaaaattgaacgcaaccccggactatgtgtaaacgttctgacagtacgtcatgtcattgctctgtctggctgacgctgcggaggaccgcagggtgcccggcctgccctctgccaggggtgccgggcccggcttgtggagtcacagcagaggccggctcacccgggagcctgactcagcagggctctctggccgcacccacgcgccctacatgccctgttcgggggaggcttccggtaggccacggagagccggtagggaggccatccccgagtggttctgactccgcccttcgagccgatgctcgcccaggccgccgagtacgttccgggctccggcgtcctggcgagcggcttcgcggcggagcagaagttcgacggccaccgcgcaattctcttcacccccgcgacttcgggcggccggctgctcctgcagacccggcgcggttccctggtccaggaccgattccccgatctggtcgcggccgctgggcagctgccggagggtctggtcctcgatggcgagctcgtcgtctgggacacggcagccggccggcccgcagtgctgcgcgcagcggggagaacgggtccggggcgcggccggtggacgcttggcgctggcgtagggcaggggcggcgctagagcgtgtctctttgatgggttggtcagttgatcggatgtgtctgtccgattagtgatcactgatgcgatgtggggccggatcgagccgctgatgccggccgatccggtccgcggccggcggtgggccgaccaccgccgcacccttgaggccatcgcttggaagtaccgcacgagctcgccctggcgggacctgcccgacgagctcgggtcgttccagaccgctcacaaacgactgctcagatgggccgtcgacggcacttgggagaaaatcctcgcctccgtcctggcagcggcggacgccgacgacgacatcgactggaccgtgtcagtggactccacggtcgtccgggcccaccagcacgcggccggcgcacgcaaaagggggcggcccgctccggcgagccctccgatcacgcgctcggacgctcacgcggcgggctgagcaccaaggttcacctggccgcggacggtggggcacggccgctggcattcaccgtcaccgcaggccaggccggtgacgcacccgccttcgagacggtgatggcccgcatccgggtgccccgcacaggcacgggcaggccgcggacccgccccttcgtcgttctggccgaccgggcctactcctcccgagccatccgcagccacctgcgacgccggggcatccgcgcggtcatcccgcagccgtccgaccagatcggccaccgcctgcggcgaggccaccgaggcggccgcccgcctggctttgaccgagaggtctacaagcagcggaacacggtcgaacgctgcatcaaccggctcaagcagtggcgcggcctggccacacgaaccgacaagctcgccatcgcctaccaggccgcactccacctcgccggcatcctcatctggacccgacgctgaccaaagagacagaacctagtcgtaggcgccggacgagtgcgctgccggggcggcgcatgatcggttcttcggtgaacgtgttccgccgccggagtgaggcgtcctccacccggtcgaatcggcggggggcggccctgtatcaccggggccatgatcatggcccgctggtctcgccgggcgggaagcggcgttcacggtccggcagggcagtcacgagggtatttaagccctttacttggctatttaccgtcataaaccgctccagcttgatcacccttcgtagcgtcatatgtgggtccgggtcacgcgcgtcccggggcctgccgatctgagaggactgtcatggagtctggggcaacgaccgcggaagagcggttggagcggtggcagggtctgctgtcgggttcgcgaagcgattcgcggacggcacggaatctggcgcgggtgccgaaggcgaacgtgttgttcggggtgctgctgcatggtgcggaccggttgcggcagggcgaggaactcaccgatctggagcacgtgctgttgggcgtgctgcgggagtcgctgggggatgaggaggtcggggagtggggccgcgtctaccgcgagtcggtgtcggctcgcggggcggcgctgacgggggtgcccggggtcatcacgggccgttcggtctccgaggggtacggcttcgcggacttggccgaggacatgccggcggtgacggcggagtggtcggcgcagtcgaactggtcggcggtcgcccccgagtcgctggcggcgggggaggctttcgacagcccggagttcaccgaggggatgcgcgagtggggatgggctgtgaccgtccccgccgatctgaccgcgcagagcgccggcgacgagccgcaggagccgcaggaaaacgatgagcgggcgggcctgtaccgcgtcaggctggactacgagaacttccacgtgcaccgcgaggtgggtgacgggtggccgggcaccagggacgagatccgctggatctccggaggccagagcgacaccaggcagcacgccgtgccgtacctgtcgcaggagttcggcggtcaccagacggacagggggcagacaccggcgttcaccggccatcggacggctttccatggtgatgctcggctcgggctggtcctgagcgtcgcgtgctgggagtgggacaccggcgacggcaacgacgacagcttccgggaagtcatgaaccggctgaacgagaatctgctcttcaacctcatctgggatgccatcggcacgttgtcgcccgacctcatcggatacctgatggacctcacgtccatggcgatcaccatcaccaacctgatcgcgaggaatgacctctccgcggcccgctcgctctacctcgaccagaaggccctggccgcgctctcccacaccggcagcgcgcagtggcacttcgccggtgacggccaccacgaactgaaggtgaggttcaccggagacaagatccccttccccgccaacgacctgcagtgcgtcatccgcaccgacaccacgtggagcgcgccgaccaccctgcccttccagggtctgagcggccccaccctggccgtccacgacaacaagctgtacctcttctacatccgcaccaacgaccaggccgtcatgtgggccagcatggacaccagcggcaactggaccacccccgcccgggtctccaccgaccgcagctggcacgcccccggcgtgacctcggccaacggaaggctgtactacgccgtcaccgggatggacaacaaggtctacacccggaccttcgcctccggaacctggcgcggccacgacgtcaggcccggctccgcgctgcacagccccgccctggccgccctcggggggcagccctggatggtcgtctgcggtctcgacgaccgcctctatctcgcccggcacaacggcaccgcctggaatgcatggtccgaggacaacctcgactggagggtggacacccacgtcgccctggccccgcacggcaaccagctgtgtcggatcgccaccggcaaggaccaacggatctacaccagcgtcagcaccaacagcggctgggtgaacggcggcatcgcctcccccaactggcgcgcctcccacgctcccgccctcgcggccaacaccgccgccaacaccctggcgatcctcatgcgcggcacggacggcgcactctgggcgggtgagttcagcggttcctggcacagcgcccacagggtccccggggccgcggccaaggaagcagccgccgccgcgtacttcaacaacaagccctacgtgatgtacgtggacaggccggggcccgggctggcgatctgaacgaaggcgcgccggatcgggacggcccgcccgcggcgcttggactggtccagcagcatccgtatggtggcgtcccgagatacgggcttgtgccgctggagcacggagagttcggtggtcacgggcaccactatggaggccgtagtgccgacgctgtgacccgattacacgggtcgcggccccgtgcgtgaaccgctcagacggcgaagaatgatctcctgtgaacgatacgaccccagtaggaaacatccccagaaacgtcgccgcaggccggtgccattatgtgtgcccgaatccataacatttcagaagttgatctatggctgtctgggaccggtctcttgaccgatttcggatgtgactccgtgctcgacggctgaggcgcctccgaacactgtgccggtacgaggggcttgcgaggacgtggacgcgccgccgggccggcctggtgctcgccgcggccatccgccggtcgctgcgtcgcgcactgccggcgaggtccgtgctgcacgctcatgggggacggagcacgctctcctccggccccgcagacaccgagccccctgtaggcaggacatgaccccttcgcacaccaccgacgagcagcttctcgctgccctcacggccctgggcatcgacgtccccgacgacctgggccacagcagccacgaccccgaactgcgcacggccgctctgtgggccctgctctggcgctccgcaggcgtcggctacgaggaatccgttgccggccccggccacgcacgcgcctacttcaccggcccctgggagtggcccctggccgaggaccaggtccggcgtgcctggttcgaactcggcttcgccggtgaccggctggactccctcaccatgacggtgccgccctggtcggtcggacttccccacgaggacgctcccgacgaccccaccgtcgcgaccgacggatgggcgtacgccgcgagcaccgctgtcggcctcgcacaggctcttctcggtccacttcggtggatgtcgtcccagcgtgccccggccgccatctcccaggccgactgcatgctacgtcgcctccaggccaccctcgaggaactcggtgacgccaccgcacacccccggtgcgagaactgcgacggcctccaacacacaactgccactgtccccgagtgcctcgactgttcagtctccgaatcagccaccaagacggagggtgccgagtagacggcggcaacccacgacagagatgctccgcgccggttgcccccaggcaaccgcagcgtgcatgccgtacttccggttgcccataggaaaccgggccgacgagccccagctgccgactcacctgaacgagctcggcggcctgcacatcggtgccgagggccgttcgtcgttcggccgccactggcaacgtctgctgagtgagcgtggttcattcttgacctacggtcgacagacgtggtggcgtagggcaccgtgacaggacctcgcatgacccgcccgaccgtcgaggtgctgcgcctgctgctgtcggcgccgccgcacgagccgctgtgggccacgggaatcggcgagcagaccggcctggactccgccgcatccgcttccacgacctccgccactcgaccgccaccctgctcctggaacgcgtcgacctcgtcgtgatcaaggaactcctcggccacgcccacataggcgtcaccgccggcgtctacgcccacgtccgactcggcctccaacgccaagccatcgacagtctgacgggtgctctcaacgcagcccctggcactgccttcgagccgcccgccgcaccaactgtccgctgacgttgccgtcagcgttgccgtcaagcggccagatgccctcccgaagggtccgggagggcatctggttgtttattgctcgacccccttcacaagacgcctggcagtatgccgtgtccgttgattagcccaatcggccgtggacaatccccgaagtaggaccaattggtctcctgggatagccctctcagacatccagcagactgcacgctctgcccagtgactgctccgacttctgatcgccattgtcagcacgtcatcgactgggaccaggctctcaagcccgtccggtgacagcttgaaccgttcagcagcagacgccaagcctgctcgcagcgacgactcatctgcgtccagaatcgtcacccaagacgagggaagaccttccgccgaggattcgactacaccatcgagtcggcctagcgtccacactcccttcctgtcgagccccagccaaatgccggtctcgctgattttcgtcagcggcagccacatgacggcgccggcttcattcgcgtgggcagagaagatccagcaggtctcaggcacggctgagagctctgccatcaaatcattttccgtcacgacacctgccttaagaactggatgcaccaggaacgtcatcctgctcaccaatgcatgctcggagtgtggctcacggttataccgtgttggcccatgaagtcctggaatgccttccttgccgaatcgtcccaggcacgggcgcgggcgcgcccgcaggagcgggggcaggtgccggagcggaaatcggtcgggcgggcgcagcccacgggtcaccggccgcgcccatgcgttcggccagcacgtccctcctgccggagcgcgaagccggcctcctgatcggctcacgcccctggccgctgctcgccgcccgcatgcagcagctcggcgaacaccacggcaccgacaccgtcgcccagcacctgaaccgtctcaccaccggtacctcctggcaggaggccaccggcagcgccctggtcggccgcctcgtcgacgccacctcatgtccctgaccaccccacccggcgcaccggcccccgcccggccccgggcctccgcggccgccgcccgctcccgctccaccaccaccccggccgccgcggcccccggccggccggccccggcggaggccgcggtccccgcccaccggcaccaggccgggcggaggtcctgcccggggtcaccgtcctcgggatggaggtcgggaagtggctggtccggcagcggagacgaacatgtcggttccggttggtcgttgaggtcaggcggcattccggtgatcggggttcgcgttctgtgttgctgactgcctctcccggtaccgtcgggcattgtcggcgatgagtcgcgccaggccacgctgcagagcgggccggatgagctcaatggccgcgccgagggtcaggcagccgccggcaagcattccccagaaggccaggtctccgaggccctccgtttcaggatccccgtagtaccgagtccccccgaggaacccgcagacaacgattgcggcgcctaggagcaggagccaccaccacaaacctcggcgacttcgctccttgcgctgcctgtctaccatcccgatcagcccctcgttcgatgatccactcatagatccccgggacactacctggccgcccctgtcccgcagaccggccgtatcaccaacccttcaccccggctcgggcaagaccagcgactccgccctcgcttccggcctgctccaagccctgggcaaaccggcccgcctcccggagatcacgctcgccgccctgcgccgggcgcgcgccgacgaaccggacttcccgcccccgatgcagcgagtcagcacgcacctctaccgcgtcggcgacctcaagaagtgggcgcgcaacctgccccgcgccgcccccggcaccaccagcctcgactgatccaccaggcagagcggcagggcggcagtccgaccgcttcgtcgaccgtaggaacttggcggtatgcggtatgcggtagctggctgcggctgcggagagaccgggcgattagggcagaccgaaaatccgcgtcgcttgtcggacctggttgccagactggtcggatgaacgagggatcatcagcccagtggctggcgcgggcgcagcagatcgatgaccggatcgaggaactccgtcccgaggccgatcgtcacgtggtcggtcagcacgtgatttcccaagtgcttctcaagcgcttcgccactccgttcggcagtaacgggcttaagcttttgcccttcaaccttgaccaccccaatcgtgtgcacaagaaggcgagcccgcgcgagtgcggcaaggtcaagcacttcgcacgcttcgcttctgcctctctggaacaggtatggggcaggcttgagacacgaatacccgacgccgcagccgcagtggatcggggcgacgtcttccaacacgaacagtatgtgcagaccctcaaggacctcatcgccctgcacctggtccgttcgctgaactaccgcgatgtccacgagcgcatcttcaccaagatctacaccgagcagcgcactgccctgctgaccgaccaatccgacctgctgcgtctcgcggtactgcagcgcagcggactccacctcgctggaccgcagggcttggtcgcagcggcggacgagatcctgcgcccacacttggcgaacttcgagaacggcgcggacttccgggcgcggatcgaggacaccttcgccaaggcgaaggagatgatcagcggcgccgggctggagattctggtgcccgccgtcggcgagtttctccttggcgacatcccggctctggcgatccggcagagtggaagcagaaccgtcttcaacgttgcgatcggcgactccaccgccatcgtgttgcccttcggccccaaacatctcctggtcggcagagcgccccgcaacggtatgggcatcgctacggaagaggcggtcggcttcctcaaccggcttcagatcgaagcagcgcagcagcgcgtctacatccgacccaacagcggccaagaggccttcgttcgcagctacctcaaacagggcggccggagtgccaggagataaaggctgaccccgggctggtcacaccacgggccccggggtcgacgatgccgtgtccgatggcggttgctgctccgctgaggagatggacgccagcctcgtcccgaaggcgcgcaaggccagcagcggccgccggtacaccggcgccgcgtacgagcagcctgtgcatctgcgtcagcccccgccggggccaaggccaaggactgagctgacccccgcgggtgctggggaccttgacccccgctccgtcggtgtccgccgacgcgagcgggtatcgctgtggcttgccgccgttcgggtggacgcggccctcacctccctgaccaccctgcccgccgcaccggcagtttcccggcctcgggtccttccgacagcggccgggtcccgctcacccaccactcccgcggcccgcggctcccggtcagctggctccggccgtgggtggctgcggtcccgtccaccgggagcaggaccgcatcgacctctacgccgagctcgccggccccgtacgcggctatccgacccagccgtagccgcgccagtccttggcggatacgggcgcgcgacggacctgaactcaccctggacgatgccgtcactgcctacgcgcgactgggtgcccgggcagggcgagtactgacatgtctcggacggtaagcggtcgagaaaaccttgttgccggaacggccctctgcccaggtcggagccgatccaggacgaccagccccggaacggtcccgggccgaaccagccgcaccgcaaccggtggtcgggcggatgagtcctcggcggcatgagcacccagcccccggccgcaggttccagcccaagtgccacgacacaacggcgcccagcgtcccgggagagcgcgaagtcgctgctcgtgggtctattggtgaggcgatcactggtgatgggaaccagcagatgtgatccggccccaccgccaggccgttaccgggcgcggctgctaccgccctcggcgacctccaggaccgttgccgccgcccacggcccgcgtccgcttcccggctgtgggtctccccgatggcggcccgttcccgctgcggcccccggcgggccggccccggtcgaagccgccgtccctgcccaccggtagcgggtcgcccatgccagggacgcgggatgcggccggtgagcaggccgtacgatccccgggggacgaggcaccgacggagttcggtcacgggagggggacggacatgaggttcttctcagtggagggccgggagtacgtcgctctcacagtgctcgggagcgacgacttcgacgctctggaagtggtggagatgactgcggctgggcgtggcgcccttttgcttgagttccggatggatgaggagaccgccacgctggtccacctcggcgcggacgtaggtattccgcttctcagggcctccttggagatcttccgcacggacttcctggagccgaggcgcgcagcggggctgccgctgccgcgctggtagccgagtccggcctacgcctggcgttccggttgccggagggagggtgcggtcgcggcggtgatgacggcccggccacgctgatgccggggactggccagccatactccggtagcgctagcgcgaggagcacccacccctcctactgcgcccagtcgacaccggcctcggcgagggcggcgagctgcgcctggtcgagcttgtcgcggcgggccttctggttgccgatccagatgccggtgcggtgctccgttccgtcgggcagctgctcgacgacggcccgccccggcagaccaccttcccgcgcgacgtactgctggagggccttaaggcccttctggaacgcctccccgccgacgcgtggcccggtggccgtggccgtcttcgccgccgccttgcgggcccgtggggccttcttcgcgccgaatgtggcgagccggcgctgctgttcctcgttcagccggtcccagttccgccgttgcgaagcgagccagcgtccgacgtcctccccgtgccgggtcacccccggcacgaccgcggtcagccccgcaccctcggcgaggagctgggcgaggtaggcgtagtgccgctgccagtccaccgtccacccacgctcgcccgggttccagtccgggtcgatcgcggccagctgcgcggcccgccgccgcgcccggtcggggtctttgccgagcccgccggggcggcggatgttcgtgagccactgccccaccgcgatgtcgaggatggccgcgccccgtggggcggcgagggtgccgtggagctggtggtaggcccgcgccgccccgaggttctggtcgaagctggcgtcggcggtgtcccacacgatccccacctcctccaactcggtggcccgctcgccggtcatggccccggcccggtaggcgcgccgccggtcggacagccaccgccccaacgggaacgccccctcggcctcgacatgctcgtacgggacgtccagatgcccctcacgctgccggtagcggtaggcggcctccgcgcctcgacgccattcctgccgctcggtgttgatgacctggtaggtgatccacttcgcgatcagtgccggatcgcggggcgtggcgaaccggaggaggagccgactctcctgctcaccctcctcaggcaccctcccgaccggcacggacgggttcacagaccttttctggttctcctgtggaacagcgagcatctccacaaccttttcatcgtgtgcccgaagcccctccaatacccggatgagcggccggtacgagttcgaggaaagcatgtcttcgggcttttcaccctcccgcaaaaacacggggacgatcagggtggctgttttgccctggccggggcgctggcgcagggcgcggccgatggtctggacgatgtcgacggcggaccctttggggtcgacgagggctactgagtccacgcttctgatgtcgacgccctcacccaggaccttgcagttgctgagtacggcgcggccggccctccggccgaagtccgcgagcacagactgccggtaggcgccctcatgatccccgcacagccatcccgaccacacccgctccggatgccgcaccgggtccacctggtgcaaccgcgaggcgacacgctgcaggccggcggcgaaggcctccgcctcgacggtccgatggtggaaggtgatcgtggtctgcaggccgtgagtgatgggcgacgtgtgagttgcagtggttggcgtcagtttgtttcagcgtggggtgtgggtgttatggctggtgggggcggggtgggggtgtcgttcgttcgctgaaggttgctgtcgttttccgctgatggttcgttgtcgtgtgtgtggttaccggtgttcggggcagtgcctggttccgtgccacctgtcgaggtgggcgtgggcttcggtgtcgcctgtggcggcgagggctgcttggcgtcgcaggaagcgtgtgtaggtgctcaggcctgtggcgaggtagatcattgctgtgcctgccactgtggagaccgcgtagaacaaggcgttgtggtccggggtggtggggatccgttcggcccacatctggctggccatgcccagggggaagaggatccagccgcggggcatcttggggccggtccagaacgttgtgtgtgcgcgggtgaggcgtcggggccatgagattcgcccgagggcttcgcggcgcatccggatggcgggggccaggaacgtgagggcgtaggtcagcttgaggagcttgccggggcgttcgtcgaggaatccgctccattcctcttcgtagcgctgcgcgagttccgcgtcggggatgcggcgggctgcccatcggatggttttgcgggccagccacgggctgatgtcgactgcttcgttgacgatcaggccgacgatgagcggggcgaggtagcgcaggaggtccatcacgcgattccccatccgggccggtgcagggggtttgcctgtgcggggcgggaggggagtgcgcctcgtcgttcgagcagcacctcgcgtacaccggcggtgccgttcggggtgagccggtagaagcgcttgcgtggtaccccggggatctgttctccggtctcccagttgctctccagccatcccgccgactccaggcgggcgaggatcgggtagacgctgccggtgggcttcctggcggcctgcgcgatggcgtatccgtgcacgttttccccggatacgagcagggcctccatcacgtcgagcgtggcttgtgtgaccttgaatggcctgtccatccttgaactctagctatatagagttaggttgtccagggttcaacagcccctgatgcaggccctccccggagccggcgcgtactcgtgggagtacgctcccgcccgccctgcccgctggcacatcactcgttggtgggatgcgatccggcgtgtccgaatggggcgcccagccgtggacagcgtttccgcggcggggatgtgcgtctgggggagggctgatggcggacagcggtgctggcagtttcaccgaacggatggtgccagctgccgcaggccggaagaccgcggtcacgcgcctgatgaccctcgatggtcgtggcgaactcggttctgcacatgtgtggttgactgcttcggccttgaacgtgtccgagcggacggtgtggaactgggtggcgctggcccgctctgagggccgaaccggacgacgcgagcccccgcagacggtggcggtggcagacctgcgtgtgcgtctggcggtgtggggtgggaacgtggccgcggtccaccgtgagctgctcgcggaagcggctgcggctggtgacctgggtccggtgccttctctgcgcactctgcagcgcgctgtgcgccgggatttgtctgtgggggagcgggcgggcctgcgcgggggtgaggcggcgcgtcgtcgtttcgacgtgtacggcaagcgcccccagactcatcgcaatgcctgctgggagggcgatcataaaaggatcccggtacgcgtggatctcgaaggctctgcggtgtgtccgtgggtgacgtggttcatcgatgtggcgtcgaaggtgatcgtgggggtagcggtcaccccgcaccagccggcccgggacgcggtcctggccgcgctgcgcacggggatcagccggacagccccctacgggccgttcggcggtctgccgggccgggtgcgtgtggaccggggcaaggacttcctgtcgaacgtggtcgcgaaggcactgggcggcttcgcggtccccgttcacgacctgccggcctacaagccctaccggaagggcaccgtggaggccctcaacagtgcggtggagcagatgctgctggtctctctgccgggctacacacgccgtgcccgccccgcgcaggcatacaggccgactccgttggaggacctgctgtcctacccggacttcgtcaaggtcctgctggactgggtggcctggtggaacagcgagcaccgtccggccggcgtaccggacgggatgaccccgcgcgaggcgtgggaggcggacccgacacccatcgaggagattccggaggagcagctggcgttcttcgcgatggaggacgacggccgtatccggaagatcaccacgaacggggtcgtgtggcggcgccgcgcctacatcgccccgtggatggccggccacgtcggcaccagggtgcgcctgcgctacctcccgcacttcgacggcaaggtcgaggtcttcaccgcagacgggcagttccggcacctgggcggcgcctatctcgctgaggccgcgacgccggcccagcgccgcgccctggcccgggtccgcgagaggaacgcccgcgcgctgaaggcggacctgaaagcagccgagaagctgagccggacccactacaccgcaacgaccaccccgggcgcgccccacccgcggcgatcggtcaccgggcagcaggcccaggaggagatcagccgcgcccgggcggtcgacctcgcggcccgcgcgctgccggacctgatcccgccgcgcgagcccccgccgggctgggcccggccccgctcccacccggacaccaccgtgctgtccgagaccgacccgcccggccccgccgcgccggacgaccacaccggcaccgagcccgcaccggacagcaaggagtgaccgagtgaccgtcatgcccacctcaccccgcaggggccgtctgcccgcggagcgggaggaccacttcatgcgcctgccgggcgcccaggtcgtctccacccgcgccctgctcaccgcccgggagaacatccgggccgcgatcgacgccaaggcgatgatctgcatctacgggcaggccggcaacggcaagtccttcgcggtcaacgcctgcctgcgcgagctcgcaccgaagctgacacgccggatccagttccgggcccggccctccacccgcgacctgcgccacgagctgttccacgccctcggcctgccgggccgcccgccggcccagcccatcgagttcgaccggatgctgcgcggcgctcttcaggaaccgcacgtcctggtctgcgacgaggcccagtggctgtcgaaactctgtttcgaatacctgcgctacctctgggatgacaccgactccgacctcacgatcgtcttcaccggcggaaacggctgcttcgagatgctgcagagcgagccgatgctggagtcccgcgtctacgcgtggcaggagatcgaccgcatgccgcgggacgaggtcctggccgtcgttccggccttccaccctgcctggacggacgcggacccggaactgatcgccttgtgcgaccgggaagcggcccacgggaacttccgggcctgggcgaagatcactcaccacctcaccgtcgggatgaaggagtccggacgcgcacacgtggacgaggaactcctgcgctgggcctacagcaaactgagccaccgccgggcggcctgatgctggactgcccgaacccgccgccggtcacggtgatcctggacccgcacgacgatgtggtccacacccgcgcggccctggcatcccacgccccgcacgaaggacgcctcaccgtccaccccaccccgggcaccgactcggccctcgcgctcgcccacgacatcctcgccgcactgaacaagcccgtacccctgaacagccaccgcccactcgacccggccccggcctggtcgaccgccgccgcctggatcctggccacccccatcacccacctgaccctgctgcgcgcccacctgctcaccccgcaccgcttcaaagacctcctggccctacgccggcgcaccggcgtccgcctggtcctcgtctgtcaccgccggaccgtccagaccttcctggaacgcgagctgcggcaggtggaacaccacatcgccgaggcctcagccctcctgcccgaagccgaaccggccgccccgcagccgccgacgcccccgacagcgaggcctttggcgaaccgctggatcagcctgcccgccctgaccaccctcaagaccttcgacgagaccgcaaccccctgccgctgcaccgcacccatggcgaaggacagggacttcttcccgccggtcataccgccggtgaccgaagcggaggtcgcccggcgccttcaccagtccacaccacacccccacctggcagcacagctcgccacagcggtattcaccgccgcctccacaacgcagctcaacaccgcgcatgtccgcgatctgggcccggacgccaccaccatcaccctccacgacgacggactgcgccagggctgcatgacccaccccgtgcccgcctgggcccgccccctgttgagagccgccgccctcctgtggagcatcgagaccggcaccaacgcacccctgttcagcgaccccctggaaatcaacggcacaccacccctgacggccttcgccgagagctgcaaactgcgcccgccccagcccccgcgccccaagcgtcgccgtaccaggagcaggacgcctcagcgctcgaaggagcccgtggcgactgtctggcctgtgtgcactgctcactaccggcgttcatggggtatcccggagccggacctgatgcagggctgtccgcacccgcctccccacacagcaaagaccatcgcccgcaaaaagaaaggatggatgccgccggactacgggctgcgcgagctccggcacctgcgctgagaggcggagagccgccccggccgcctaccgcccgaggcgggctccctgcggcttcggaggctacgcgttgctgtcgtgctggcgccggcgacgctcgagccagccggggtcacgtacgggtacggccacggaggaactttcctccactaggtcagcgtccgagatggccatgattctgtcgaacagccagacgaaccgggcgaaccgtagggccgcgaagacgatggcgtactcgaagatgaagcgggcggagagagggtcattgtcccggtcgagcgagaaggcggccaggatcagcgcacaggtcagtgcggtgccctgcagcaggctgcgccaggtccgcctgagctcgccgtgccgttgccgtcgtacggcactcaaacgcgcgccgttagccgtggtgtagatggcgatggcgatggcgctgagaccgccgatggctgacaccgccccggttgcggctgcgtacatgtcggtgcgctgggtggcgccgatccacgtgagccagtctcccgatcctgacgcccggatgataaggaggtgggcgccaagggttgtcaccgcgaccaggtagtcggcccagacgcgctcggcccacttgtcgatgatgctcgtacggacgcccacacgatccccccgcctaggtcatgaatcccccgcgtccaccgcgagccggagcgcgtcctcatgctcggccgctgctgccaggatggcatccaccgctgacacgatccggatcgagttgccttccgcgtccgtggccggcactcgcttcttggccgtgatgctgtgttcgaccagctcg

(The sequence listing continues in the following parts.)

What is claimed is:

1. A *Streptomyces spororaveus* strain SC263 deposited with the German Collection of Microorganisms and Cell Cultures (DSMZ) under accession number DSM 34277.

2. A composition comprising the strain SC263 of claim 1.

3. The composition of claim 2, wherein the *Streptomyces spororaveus* strain SC263 is viable.

4. The composition of claim 2, wherein the *Streptomyces spororaveus* strain SC263 is inactivated.

5. An antibiotic produced by the strain SC263 of claim 1.

6. The antibiotic of claim 5, wherein the antibiotic exhibits an apparent molecular weight of larger than 5 kDa measured by membrane-filtration concentration.

7. The antibiotic of claim 5, wherein the antibiotic exhibits an apparent molecular weight of 10 kDa to 100 kDa, measured by membrane-filtration concentration.

8. The antibiotic of claim 5, wherein the antibiotic is effective against fungi.

9. The antibiotic of claim 5, wherein the antibiotic is effective against Gram-positive bacteria.

10. An antimicrobial composition or pharmaceutical composition comprising the antibiotic of claim 5 and a pharmaceutically acceptable carrier.

11. An antimicrobial composition or pharmaceutical composition comprising the strain SC263 of claim 1, and a pharmaceutically acceptable carrier.

12. The composition or pharmaceutical composition of claim 10, which is effective for treatment of a fungal infection.

13. The composition or pharmaceutical composition of claim 10, which is effective for treatment of a bacterial infection.

14. The composition or pharmaceutical composition of claim 11, which is effective for treatment of a fungal infection.

15. The composition or pharmaceutical composition of claim 11, which is effective for treatment of a bacterial infection.

16. The composition or pharmaceutical composition of claim 13, which is effective against Gram-positive bacteria.

17. The composition or pharmaceutical composition of claim 15, which is effective against Gram-positive bacteria.

18. The composition or pharmaceutical composition of claim 10, which is administered topically.

19. The composition or pharmaceutical composition of claim 11, which is administered topically.

\*    \*    \*    \*    \*